(12) United States Patent
Zheng et al.

(10) Patent No.: US 7,510,850 B2
(45) Date of Patent: Mar. 31, 2009

(54) ISOLATION OF THE MITOTIC SPINDLE MATRIX AND ITS METHODS OF USE

(75) Inventors: Yixian Zheng, Baltimore, MD (US); Ming-Ying Tsai, Perry Hall, MD (US)

(73) Assignee: Carnegie Institution of Washington, Washington, DC (US)

( * ) Notice: Subject to any disclaimer, the term of this patent is extended or adjusted under 35 U.S.C. 154(b) by 0 days.

(21) Appl. No.: 11/598,148

(22) Filed: Nov. 13, 2006

(65) Prior Publication Data

US 2007/0141652 A1 Jun. 21, 2007

Related U.S. Application Data

(60) Provisional application No. 60/794,099, filed on Apr. 24, 2006, provisional application No. 60/781,738, filed on Mar. 14, 2006, provisional application No. 60/735,168, filed on Nov. 10, 2005.

(51) Int. Cl.
*C12Q 1/48* (2006.01)
(52) U.S. Cl. ........................................................ 435/15
(58) Field of Classification Search .................... 435/15
See application file for complete search history.

(56) References Cited

OTHER PUBLICATIONS

Tsai et al., Current Biology, 15, 2156-2163, 2005.*

* cited by examiner

*Primary Examiner*—Maryam Monshipouri
(74) *Attorney, Agent, or Firm*—Morgan, Lewis & Bockius LLP

(57) ABSTRACT

The invention encompasses a purified preparation of the mitotic spindle matrix essential for mitotic spindle assembly, which allows for identifying an agent that modulates a cell division and/or differentiation signaling pathway comprising determining the effect of the agent on spindle formation, MT nucleation, or lamin matrix assembly wherein the change in spindle formation, MT nucleation or lamin matrix assembly.

11 Claims, 17 Drawing Sheets

Figure 7:
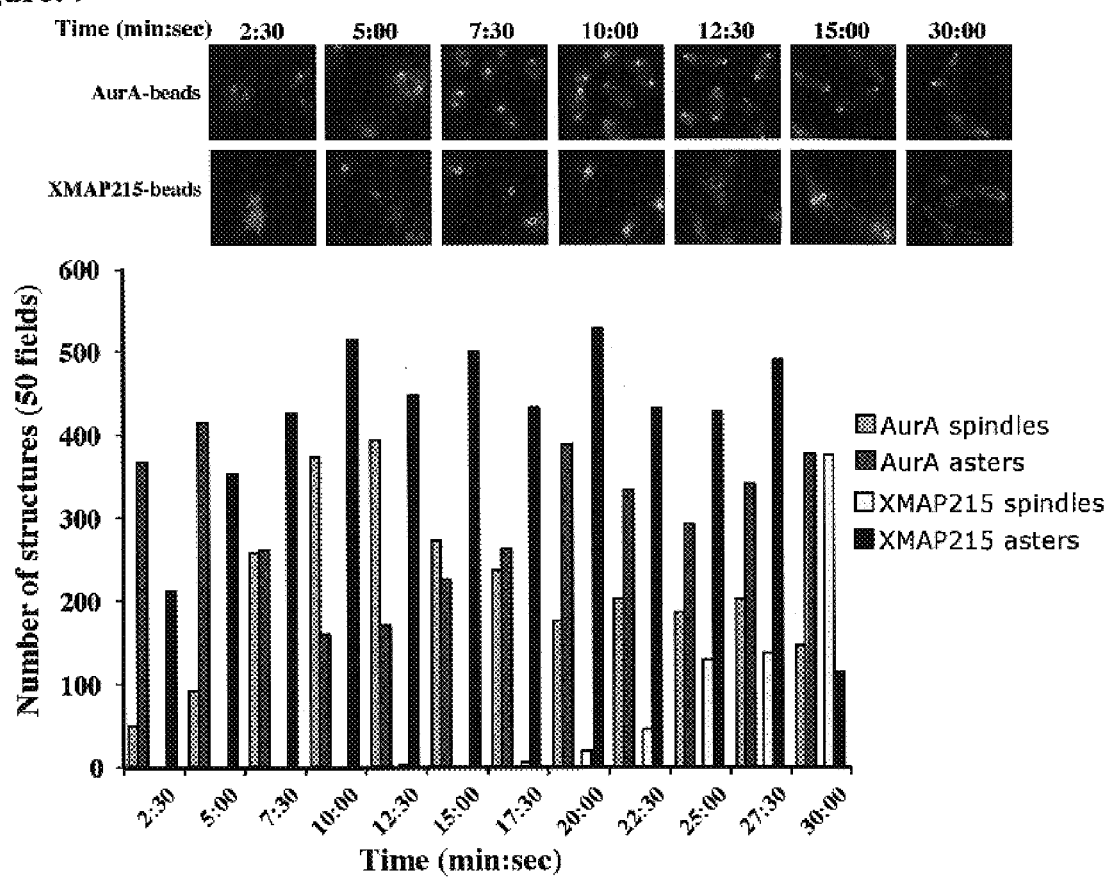

Figure 1
Fig. 1A
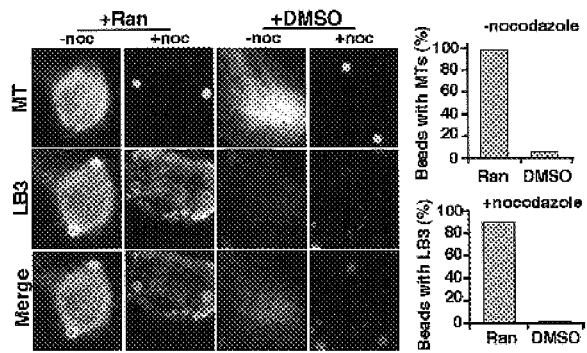
Fig. 1B
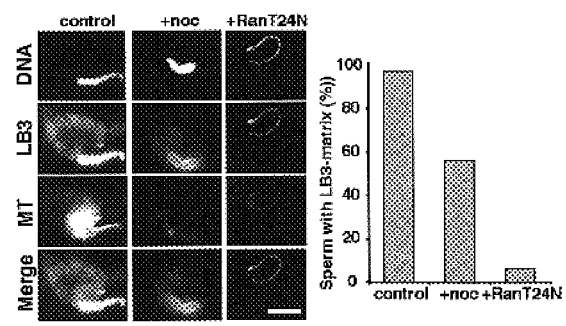
Fig. 1C
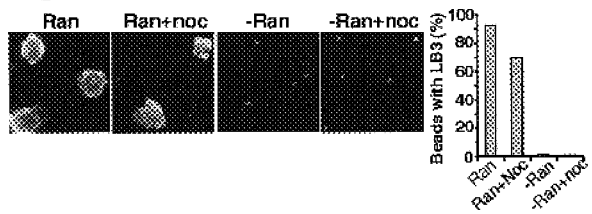
Fig. 1D
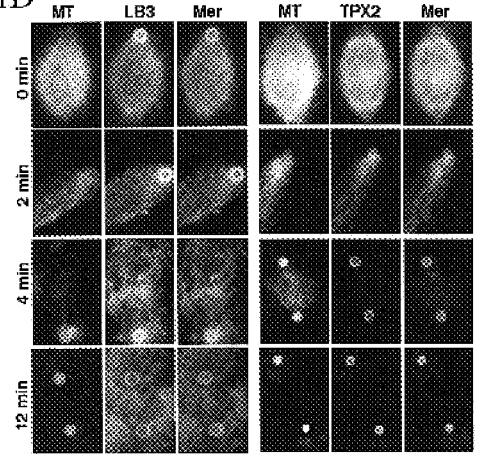

Figure 2
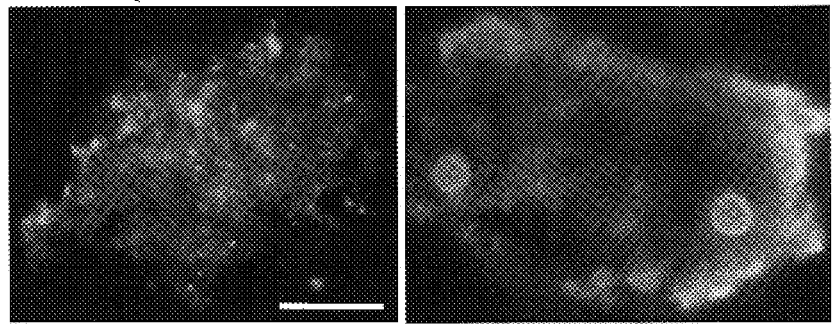
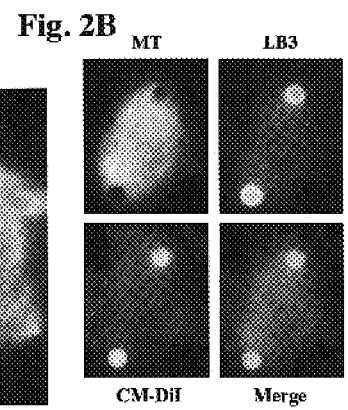
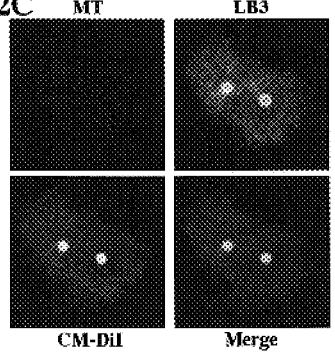
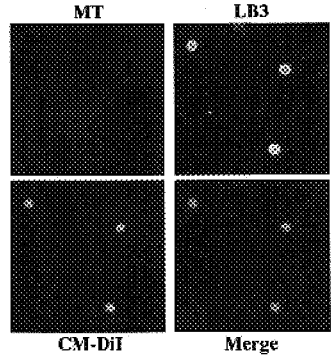

Figure 3
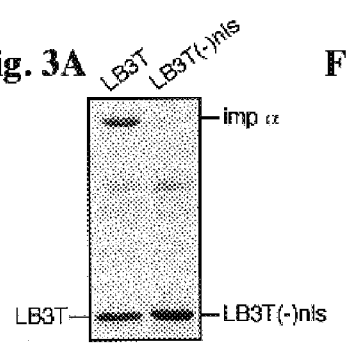
Fig. 3A
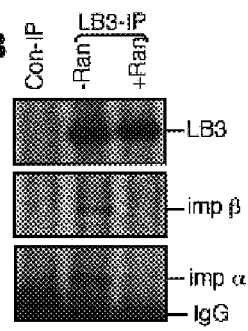
Fig. 3B
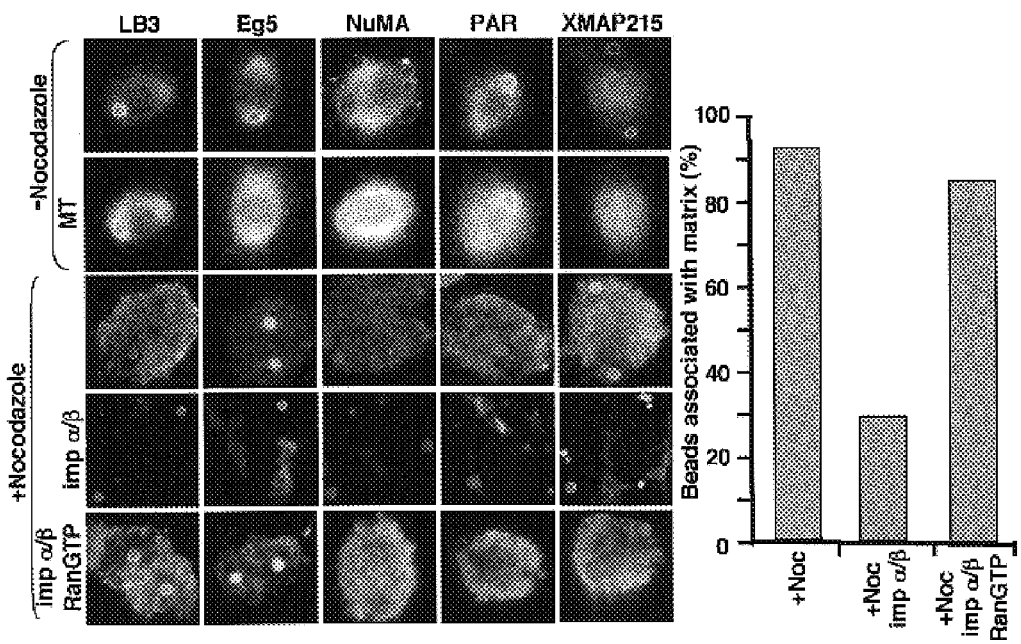
Fig. 3C

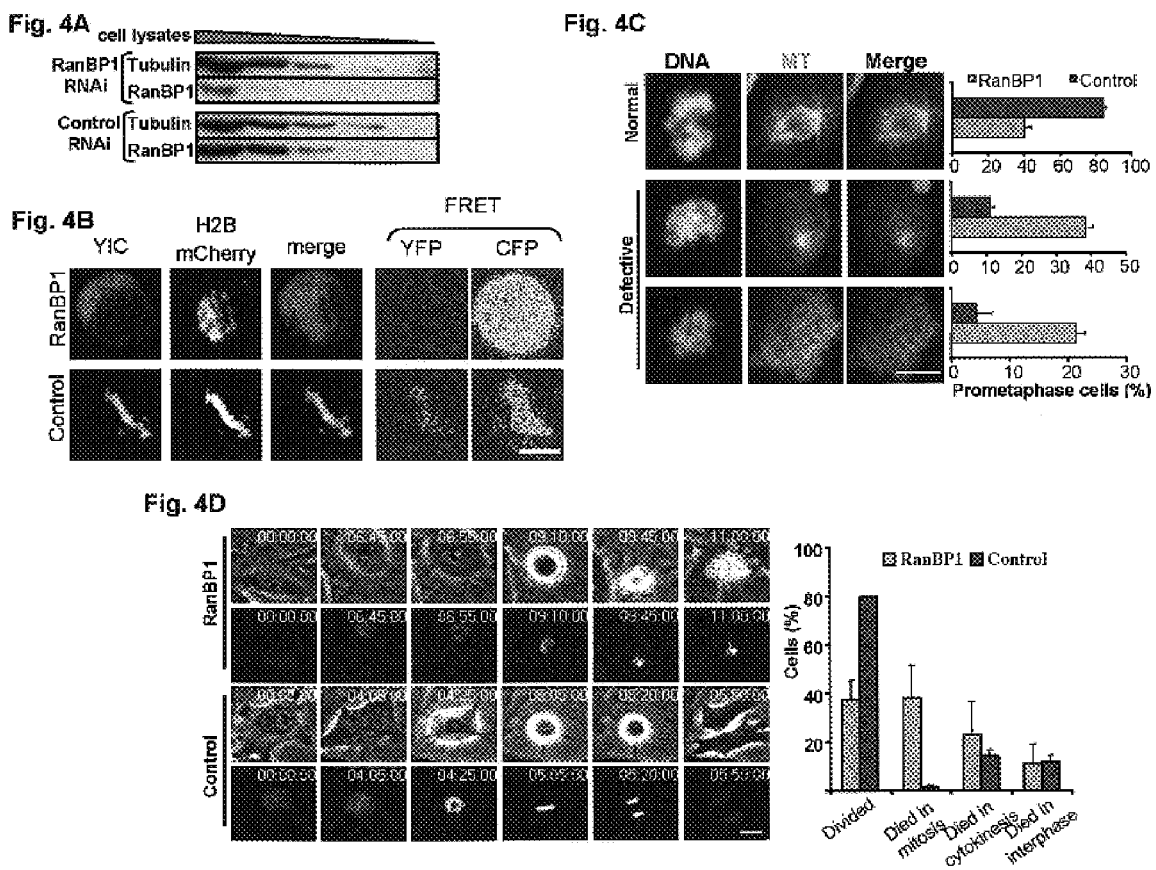

Figure 5
Fig. 5A
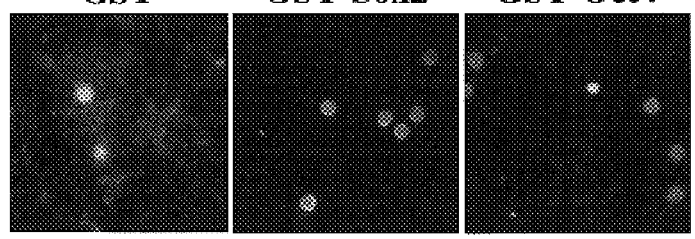
Fig. 5B
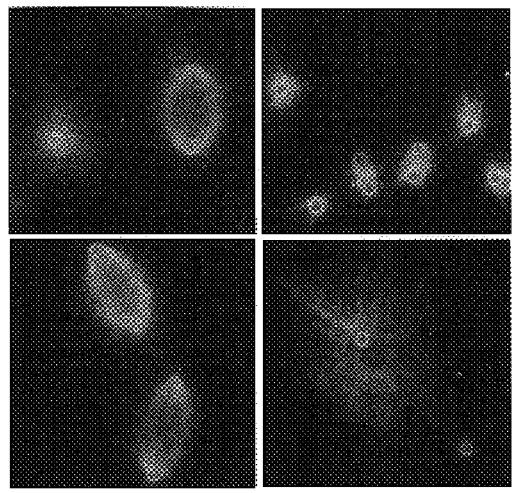
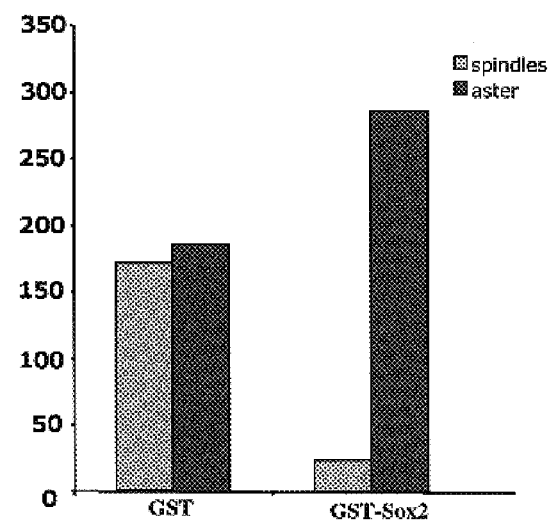

Figure. 6
Fig. 6A
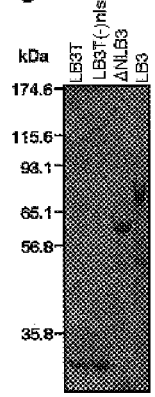
Fig. 6B
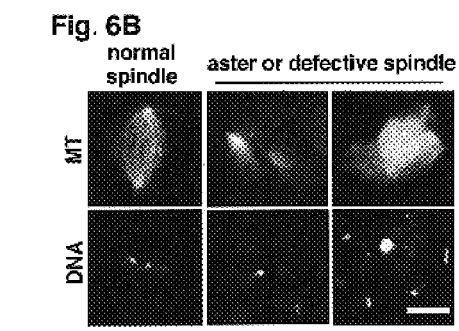
Fig. 6C
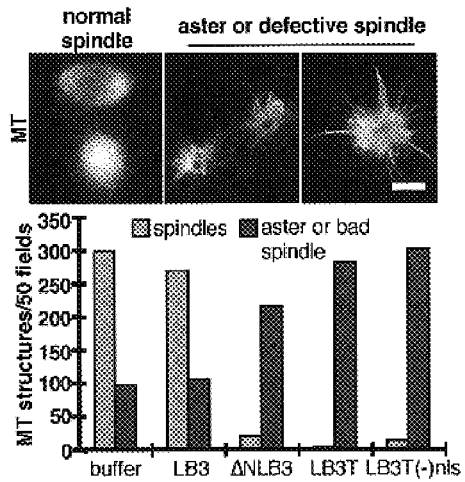
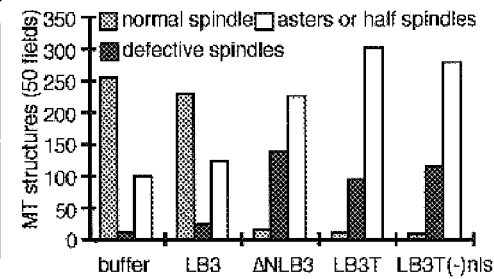
Fig. 6D
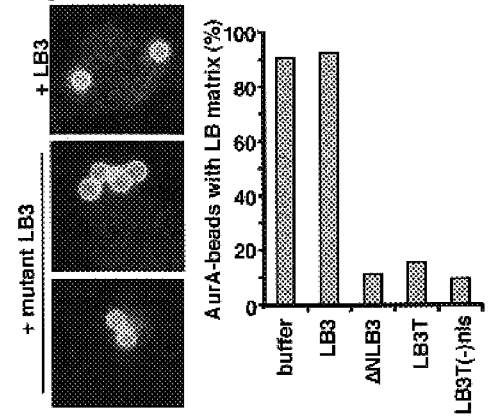

Figure. 8
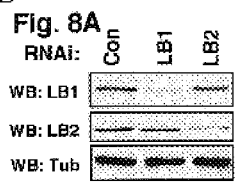
Fig. 8A
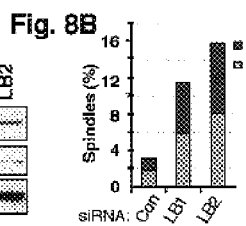
Fig. 8B
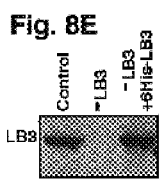
Fig. 8E
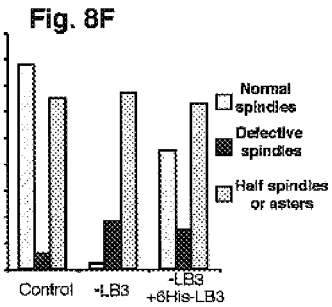
Fig. 8F
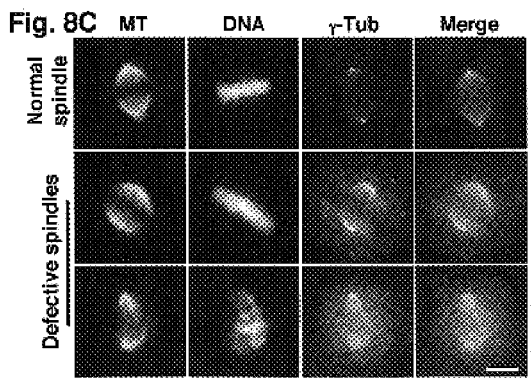
Fig. 8C
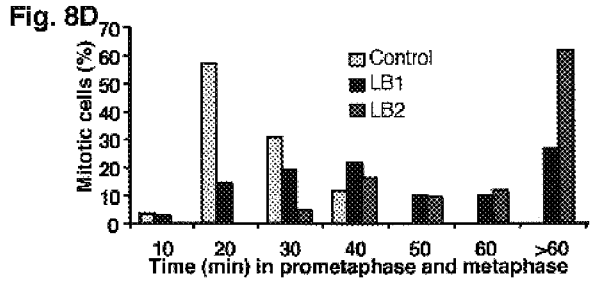
Fig. 8D
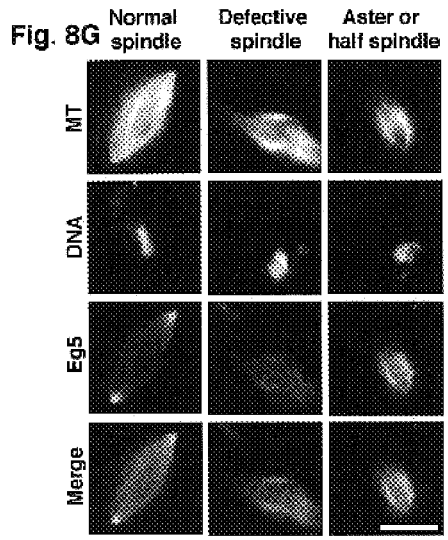
Fig. 8G Figure 10
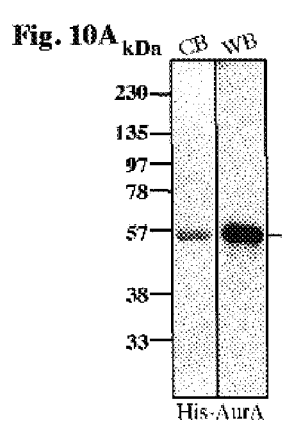
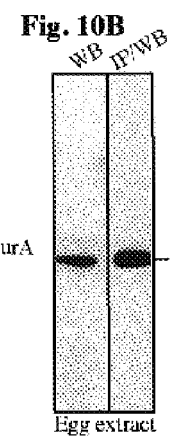
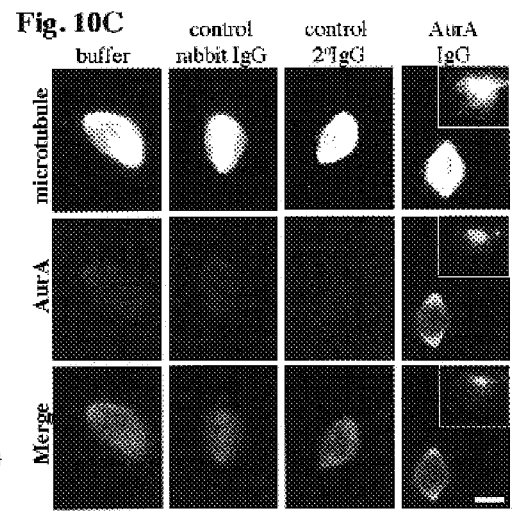
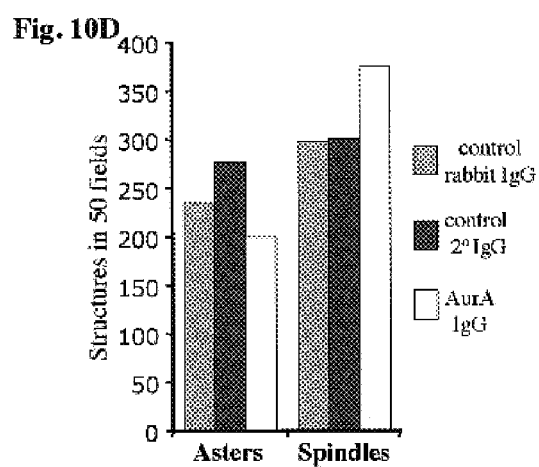

Figure 13
Fig. 13A
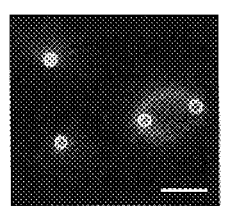
Fig. 13B
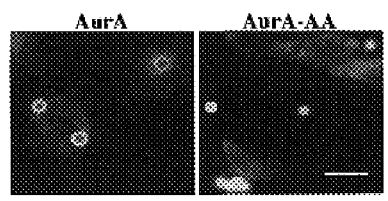
Fig. 13C
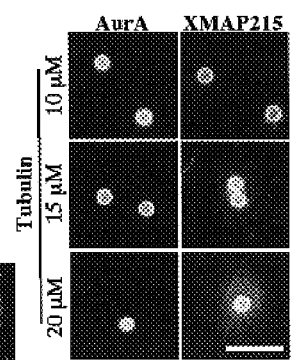
Fig. 13D
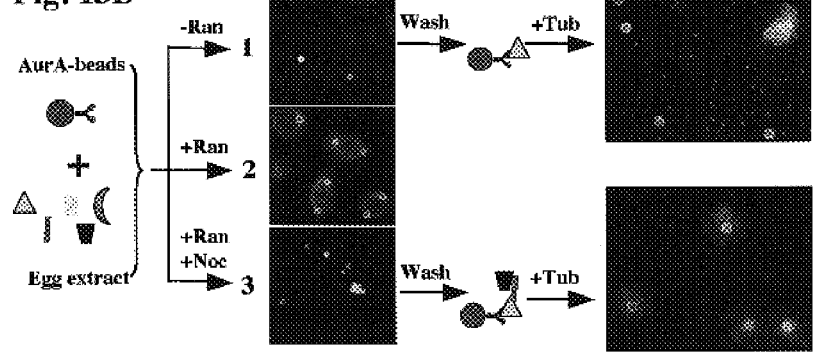

Figure. 14
Fig. 14A
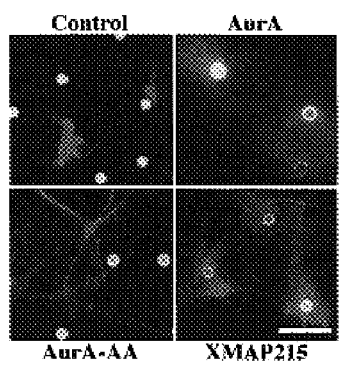
Fig. 14B
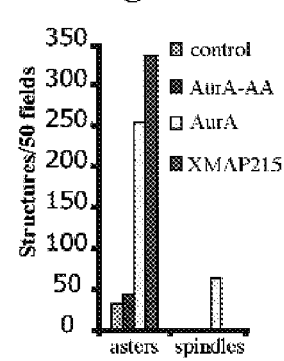
Fig. 14C
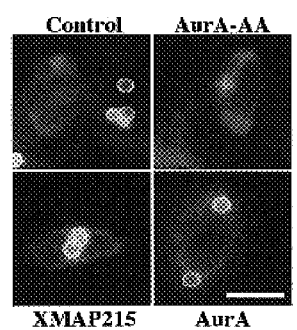
Fig. 14D
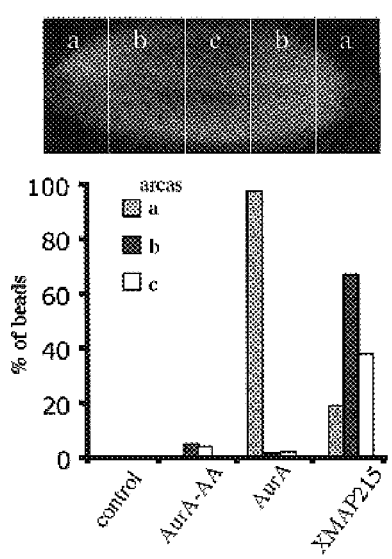
Fig. 14E
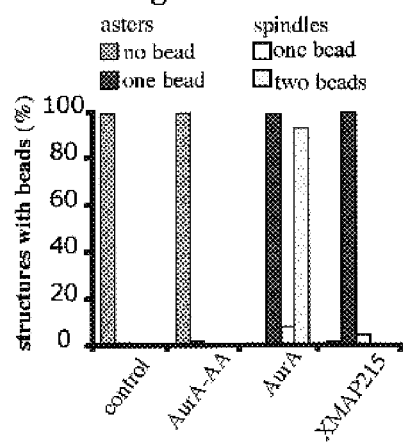

Figure 15
Fig. 15A
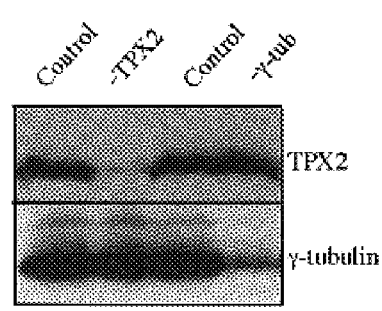
Fig. 15B
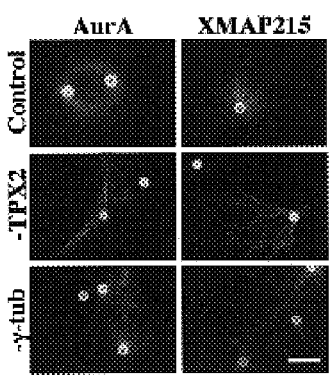
Fig. 15C
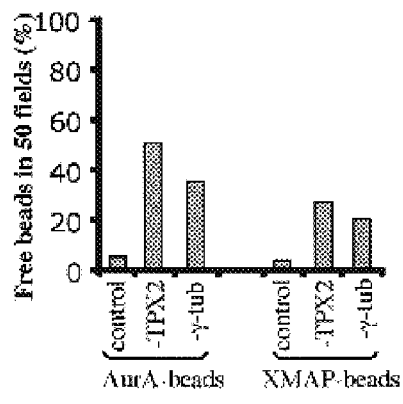
Fig. 15D
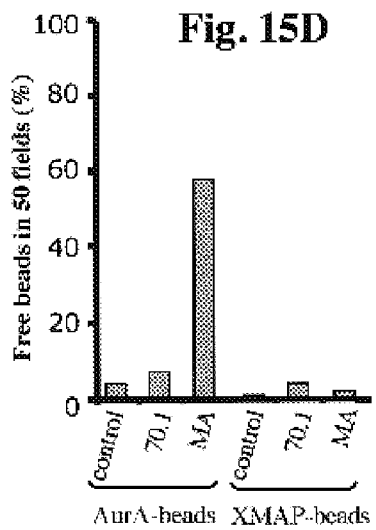

Figure. 16
Fig. 16A
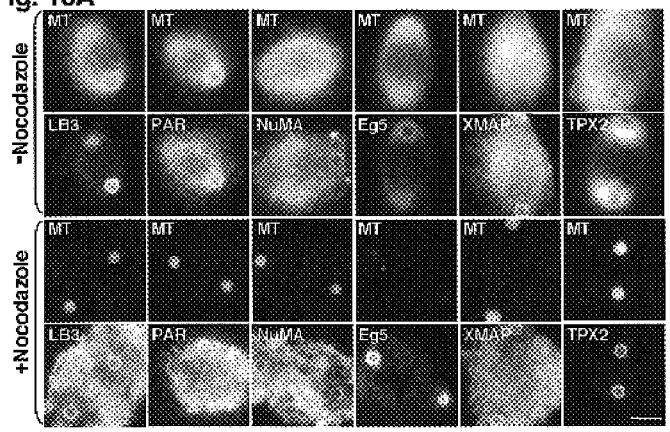
Fig. 16B
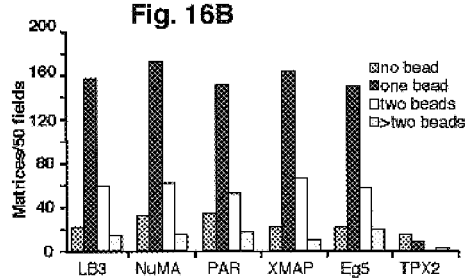
Fig. 16C
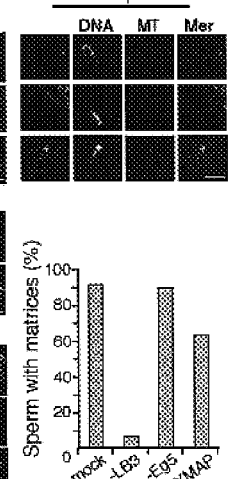
Fig. 16D
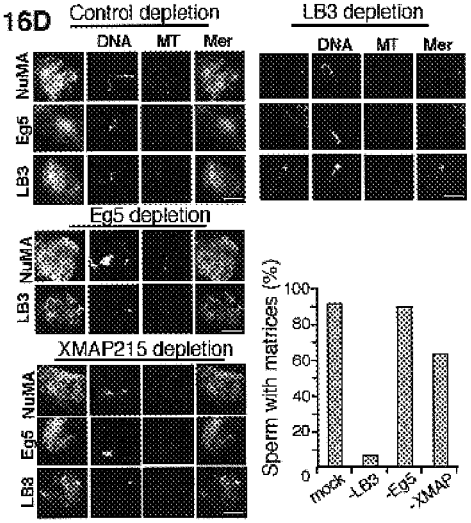
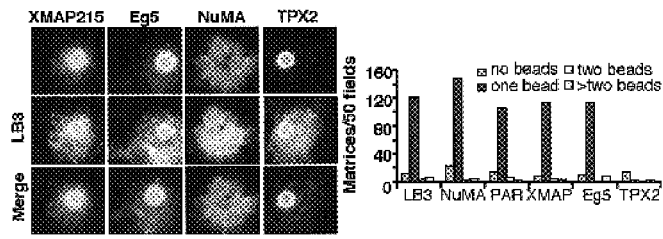

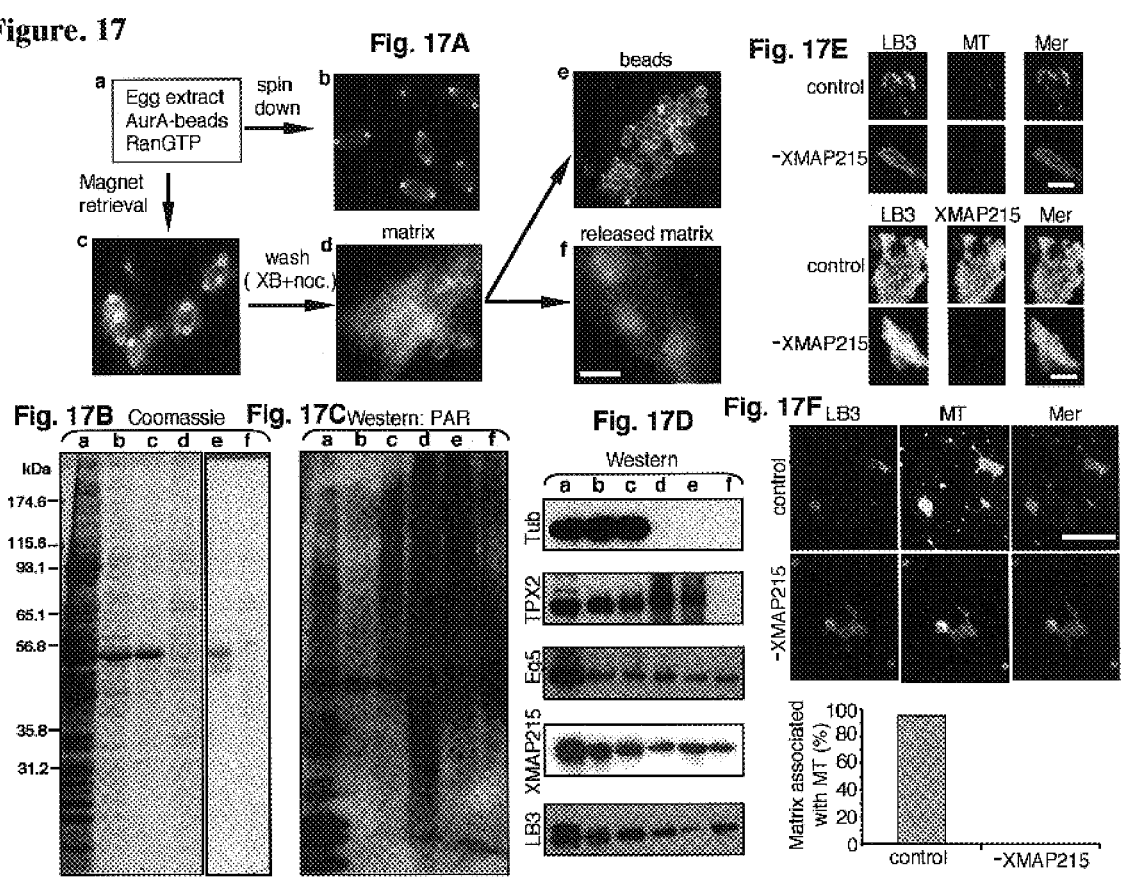

ISOLATION OF THE MITOTIC SPINDLE MATRIX AND ITS METHODS OF USE

CROSS REFERENCE TO RELATED APPLICATIONS

This application claims the benefit of U.S. Provisional Applications 60/735,168 (filed Nov. 10, 2005), 60/781,738 (filed Mar. 14, 2006) and 60/794,099 (filed Apr. 24, 2006), all of which are hereby incorporated by reference in their entirety.

ACKNOWLEDGMENT OF FEDERAL SUPPORT

This present invention arose in part from research funded by federal grant from the National Institutes of Health, Grant No. 5R01GM56312.

REFERENCE TO A SEQUENCE LISTING

The sequences listing submitted on the four compact discs are incorporated by reference in their entirety. The four compact discs are: CFR (File name: 056100-5058 Sequence Listing.txt; Date of creation: Feb. 12, 2007; File Size: 5,407 KB), Copy 1 (File name: 056100-5058 Sequence Listing.txt; date of creation: Feb. 12, 2007; file Size: 5,407 KB), Copy 2 (File name: 056100-5058 Sequence Listing.txt; date of creation: Feb. 12, 2007; file Size: 5,407 KB), and Copy 3 (File name: 056100-5058 Sequence Listing.txt; date of creation: Feb. 12, 2007; file Size: 5,407 KB). Copy 1,2 and 3 are identical, submitted on compact disc under 37 C.F.R. § 1.821(c) as the Paper Replacement copies of the Sequence Listing. Copy 1, 2 and 3 are also identical to the CRF submitted on compact disc under 37 C.F.R. § 1.821(e).

FIELD OF THE INVENTION

The invention relates to the identification and isolation of a mitotic spindle matrix, which allows the assay and identification of cell division and cell differentiation signaling pathways.

BACKGROUND

1. Cell Division in Development, Adult Tissue Homeostasis, and Disease

Metazoan cell division involves dramatic changes of cellular structures. Both secretion and endocytosis are either greatly slowed down or stopped as the cell prepares for mitosis [1-3]. As mitotic spindle assembly progresses and chromosomes further condense [4], the dissolution of nuclear envelope and nuclear lamina [5] is accompanied by the fragmentation of Golgi ribbons [6] and changes in other membrane compartments including the endoplasmic reticulum [7], the endosomes [3], and the mitochondria [8]. Therefore, successful mitosis requires not only an equal segregation of chromosomes into daughter cells but also proper partitioning of other cellular components such as the membrane systems.

Proper cell division is fundamentally important in normal development and tissue homeostasis. For example, equal chromosome segregation during cell division is required for maintaining genome stability [4]. Correct segregation of nuclear materials, including transcription factors, is essential for the daughter cells to reestablish the interphase nuclei with appropriate transcription programs that allow them to either progress along an appropriate differentiation pathway or to remain undifferentiated (as in the case of division of progenitor and stem cells) [9]. Moreover, proper partitioning of the membrane system is necessary to ensure that each of the daughter cells can reestablish both endocytic and exocytic pathways that allow them to send and receive signals and to coordinate organogenesis and tissue homeostasis [10].

Inappropriate cell division could lead to defects in development and adult tissue homeostasis, which results in disease. Indeed, many human diseases, including cancer, premature aging, disease of the vasculature and the airway, and diabetes, are directly related to problems in cell division, differentiation, and cell death. For example, cancer is a result of uncontrolled cell division. Premature aging such as certain types of laminopathy is largely caused by lack of cell proliferation. Increased proliferation and decreased apoptosis of smooth muscle cells contribute toward airway obstruction in asthma, atheroma and restenosis after vascular injury.

2. The Role of Mitotic Spindle Morphogenesis in Cell Division and Differentiation The assembly of the microtubule (MT)-based bipolar spindle apparatus is essential for cell division. One of the important functions of the spindle apparatus is to capture the condensed chromosomes on the MT-based spindle fibers. Equal chromosome segregation requires that each sister chromatids to be captured by spindle fibers originated from opposite spindle poles. An elaborate surveillance system called spindle checkpoint has evolved to monitor the capture of chromosomes by the spindle fibers. The spindle checkpoint senses inappropriate chromosome capture and is able to arrest mitosis until all chromosomes have achieved correct attachment to the spindle.

Another important function of the spindle apparatus is to regulate cell differentiation during development. The position and geometry of mitotic spindle can determine the plane of cell division. Studies in multiple systems have shown that cell-cell signaling regulates spindle positioning and spindle shape. The mitotic spindle in turn functions to differentially partition cell fate determinants into daughter cells. Through differential interaction with the membrane systems, the mitotic spindle also actively segregate signaling molecules into one but not the other daughter cells [11].

3. The Mitotic Spindle as a Target of Therapeutic Interventions and its Current Limitations The importance of spindle morphogenesis in maintaining genome stability and in ensuring proper cell differentiation makes it an ideal target for therapeutic interventions of many diseases. For example, chemicals such as taxol that disrupts proper MT polymerization have been developed to treat cancer [12]. Additional chemicals that disrupt either MT-based motor proteins [12] or kinases that regulate cell division, such as CDK kinases [13], Polo-like kinase 1 [14], and Aurora A and B kinases [15] are at different stages of development or clinical trials. Extensive studies have shown that many of these chemicals can cause prolonged cell division block and initial tumors regression. However, a number of outcomes of such treatments eventually render additional genomic instability and tumor re-growth as some tumor cells escape the prolonged mitotic arrests, survive and continue to undergo cell cycle [16]. The limited success of anti-cancer drugs calls for the development of additional chemicals that can both arrest tumor cell division and cause cell death. However, the current understanding of spindle morphogenesis has put a significant constraint on the development of assay systems to identify such kind chemicals.

Differentiation of stem cells into different tissues holds great promise in the treatment of various human diseases. The ability of mitotic spindle to orchestrate differential partitioning of cell fate determinants offers a great potential to identify compounds that could induce lineage specific tissue differentiation from stem cells cultured in vitro. However, the lack of understanding of how the mitotic spindle interacts with cell fate determinants has made it difficult to design strategies to identify such compounds.

4. The Identification of Mitotic Spindle Matrix Presents a Conceptual Advancement of Understanding the Role of Spindle Morphogenesis in Cell Division and Cell Differentiation Mitotic spindle assembly and chromosome segregation is a dynamic and force production process, which requires coordinated actions of MTs, MT-based motors, MT-binding proteins, and chromosomes [17, 18]. Although much progress has been made in understanding how the MT-based spindle regulates chromosomes segregation, it has become apparent that proper spindle morphogenesis and cell division involves additional intracellular structures besides the MT cytoskeleton. Indeed, it was hypothesized decades ago that a static scaffold, called the spindle matrix, exists during mitosis and is required for cell division. Such a matrix could tether spindle assembly factors (SAF) to support the assembly and force production of spindle microtubules [19-21]. However, the existence and molecular nature of the spindle matrix had remained elusive until our recent discoveries, which are disclosed in this invention.

Previous studies have shown that the guanosine triphosphatase (GTPase) Ran, a protein with well-established function in interphase nuclear trafficking, plays an important role in regulating spindle morphogenesis in mitosis [22-29]. Moreover, it was determined that RanGTP functions in a signaling pathway that leads to the activation of the mitotic kinase Aurora A [30, 31]. Based on these findings, a number of assays have been devised that allowed identification, biochemical isolation and characterization of the mitotic spindle matrix [32, 33].

As disclosed in this invention, it was determined that RanGTP induces the assembly of the mitotic spindle matrix, which is essential for spindle morphogenesis [33]. It was demonstrated demonstrated that the mitotic spindle matrix associates with spindle microtubules and consists of a membrane system and the polymerized nuclear lamin B. Moreover, this matrix tethers a number of spindle assembly factors that are known to promote both microtubule nucleation and organization. Finally, the mitotic spindle matrix contains transcription factors and signaling molecules known to regulate cell proliferation, stem cell pluripotency, and cell differentiation. These discoveries provide an important conceptual advancement that explains how mitotic spindle morphogenesis is required for not only chromosome segregation but also for the partitioning of cell fate determines and membrane systems into daughter cells. Therefore, the mitotic spindle matrix identified in this invention differs significantly both in its functions and contents from the originally hypothesized spindle matrix. The mitotic spindle matrix is also distinct from the interphase nuclear lamina in its structure, composition, function, and the requirement of the mitotic state for its assembly.

5. The Ability to Prepare and Isolate the Mitotic Spindle Matrix Offers Distinct Approaches to Assay for Cell Division and Differentiation The characteristics of the mitotic spindle matrix disclosed in this invention allow us to devise methods (also disclosed in this invention) to prepare and isolate the mitotic spindle matrix. These methods are conceptually and practically distinct from the existing methods of isolating mitotic spindles. The existing spindle-isolation methods involve the removal of DNA and RNA and the utilization of detergents [34], which prevent the isolation of a fully functional mitotic spindle matrix. By modulating the mitotic spindle matrix, our invention offers distinct strategies to manipulate cell division and differentiation potentials that are not currently available.

SUMMARY OF THE INVENTION

The invention discloses the identification and isolation of a mitotic spindle matrix that are essential for microtubule nucleation and spindle assembly. It encompasses a method for identifying an agent that modulates a cell division and/or differentiation signaling pathway comprising contacting a plurality of beads or dots, each of said plurality of beads or dots comprising at least one protein with a biological sample in the presence or absence of said agent; and determining the effect on spindle formation, MT nucleation, or lamin/membrane containing matrix assembly wherein the change in spindle formation, MT nucleation or lamin/membrane containing matrix assembly compared to a control indicates an agent capable of modulating a cell division and/or differentiation signaling pathway.

In some embodiments, the cell division and/or differentiation signaling pathway is selected from the group consisting of a GTPase protein signaling pathway, a kinase signaling pathway, an ubiquitin signaling pathway, an apoptosis and capsase signaling pathway. GTPase protein signaling pathways are selected from the group consisting of Ran, Rab, Ras, Rho, Cdc, and Rac while kinase protein signaling pathways are selected from the group consisting of Aurora A and B.

In some embodiments, the biological sample is a cell line, or cell lysate or extract and the cells are HeLa cells, NIH3T3 cells or murine embryonic stem cells while the extract is a *Xenopus* egg extract or *Drosophila* embryo egg extracts. In some embodiments, the beads or dots comprise antibodies which bind to the protein involved in the cell division and/or differentiation signaling pathway. In some embodiments, the protein is a kinase protein, including a wild-type kinase protein such as, but not limited to, Aurora A.

In some embodiments, the control is a negative control which does not comprise the agent and/or comprises a mutant kinase with one or more amino acid substitutions or deletions. In other embodiments, the control is a positive control which comprises an inhibitor of MT nucleation, spindle formation or lamin/membrane matrix formation. The invention includes methods which further comprise determining the effect of the agent on post-translational modification of one or more proteins and/or translation of one or more proteins.

In other embodiments, the methods of the invention further comprise determining the interaction of a lamin B/membrane matrix with a cellular component selected from the group consisting of: one or more RNA molecules, transcription factors, mitochondria, and membrane components.

In yet other embodiments, the test agent is selected from the group consisting of a protein, chemical compound, an antibody, a ribozyme, a nucleic acid, a polypeptide, an antisense nucleic acid molecule, and an interfering RNA (RNAi) molecule. Proteins include, but are not limited to, Spindle Assembly Factors, filament proteins, and kinesins. In some embodiments, the beads are magnetic beads and the dots are quantum dots.

The invention includes any agents identified by the above methods of the invention. The invention also includes a method of treating a proliferative or aging disease in a subject in need of such treatment comprising administering a therapeutically effective amount of a pharmaceutical composition comprising the identified agent.

In some embodiments the proliferative disease is selected from the group consisting of cancer and blood vessel proliferative disorders. Types of cancer include, but are not limited to, squamous cell carcinoma, astrocytoma, Kaposi's sarcoma, glioblastoma, multiple myeloma, lung cancer, bladder cancer, head and neck cancer, melanoma, ovarian cancer, prostate cancer, breast cancer, small-cell lung cancer, glioma, colorectal cancer, genitourinary cancer, gastrointestinal cancer. Types of blood vessel proliferative disorders include, but are not limited to, diabetic retinopathy, age-related macular degeneration, retinopathy of prematurity, arthritis and restenosis. In some embodiments, the aging disease is laminopathy or progeria.

The invention also encompasses a kit for identifying an agent that modulates spindle formation, microtubule (MT) nucleation or lamin/membrane assembly comprising a plurality of beads or dots, each of said plurality of beads or dots comprising a protein involved in a cell division and/or differentiation and signaling pathway, and at least one antibody to said protein. In some embodiments, they are selected from the group consisting of porous beads, nonporous beads and magnetic beads. In other embodiments, the dots are quantum dots.

BRIEF DESCRIPTION OF FIGURES AND TABLE

FIG. 1: Requirement of RanGTP for assembly of LB3-matrices. (FIG. 1A) Association of LB3-matrices with AurA-beads in the presence of RanGTP. MT assembly was induced with AurA-beads and RanGTP or AurA-beads and DMSO, and MTs were subsequently depolymerized with nocodazole. The percentages of AurA-beads that were associated with MTs (red) or LB3 matrix (green) under different conditions were quantified. (FIGS. 1B and C) Requirement of RanGTP but not MT polymerization for assembly of LB3-matrices around AurA-beads (1B) or sperm chromatin (1C). AurA-beads (1B) were incubated with egg extracts with or without RanGTP in the presence or absence of nocodazole. Images show AurA-beads (red) and LB3-matrix (green). Results were quantified as above. Sperm chromatin (1C) was incubated with M-phase egg extracts in the presence or absence of nocodazole or RanT24N for 5 min. MT (red), LB3 (green), and chromatin (blue). (FIG. 1D) Association of LB3-matrices with spindle MTs. Spindle assembly was induced with AurA-beads and RanGTP. The presence of MTs, LB3 or TPX2 was examined at the indicated time after nocodazole addition. Scales: white bar, 10 μm; magnetic beads, 2.8 μm.

FIG. 2: The fibrillar-granular LB3-matrices contain lipids and are completely disrupted by 0.1% Triton X100. (2A) Matrices associated with sperm chromatin or AurA-beads were enlarged to show the details of the fibrillar-granular LB3-matrices (green) associated with sperm chromatin (blue) or AurA-beads (red). (2B) Detection of lipids on spindles assembled with AurA-beads and RanGTP. Lipid, MTs, and LB3 were labeled with CM-Dil (green), tubulin (red), and LB3 (blue) antibodies. The images are pseudo colored. (2C) Detection of lipids on LB3 matrices. (2D) Disruption of LB3-matrices by Triton X100. Scales: white bar, 10 μm; magnetic beads, 2.8 μm.

FIG. 3: Effects of importin alpha and beta on LB3-matrices that contain SAFs. (3A) Binding of the nuclear localization signal (NLS) in the C-terminus of LB3 to importin alpha. LB3T and LB3T(−)nls were expressed and purified as S-tagged (a 15-meric peptide from ribonuclease S-protein) fusion proteins. SDS-PAGE and Coomassie blue staining showed that LB3T, but not LB3T(−)nls, was associated with importin alpha. (3B) Sensitivity of the interaction between LB3 and importin alpha and □eta in the egg extract to RanGTP. Control IgG or LB3-IgG was used to immunoprecipitate proteins from egg extract in the presence or absence of RanGTP. More importin alpha and □eta were co-immunoprecipitated with LB3 in the absence of RanGTP than in the presence of RanGTP. (C) Disruption of matrices by importin alpha and □eta. Spindle assembly was induced with AurA-beads and RanGTP. The reaction was diluted 100-fold in XB containing nocodazole and purified importins alpha and □eta (2 μM each) or nocodazole and purified RanGTP (5 μM) with importins alpha and □eta (2 μM each). The graph on the right shows quantification of beads associated with LB3-matrices under these conditions. Similar percentages were observed for matrices containing SAFs. Scale, (magnetic beads), 2.8 μm.

FIG. 4: Disruption of mitotic spindle and matrix assembly by elevating RanGTP-importin beta concentrations leads to mitotic cell death. (4A) Reduction of RanBP1 by siRNA. Decreasing amount of cell lysates (10, 5, 2.5, 0.5, 0.25 μl) were loaded. Western blotting revealed that RanBP1 siRNA reduced RanBP1 protein level without affecting the levels of tubulin. Estimated RanBP1 reduction is 75-90%. (4B) Reduction of RanBP1 disrupts chromosomal RanGTP-importin beta concentration gradient and leads to an overall increase of RanGTP-importin beta concentration throughout the mitotic cytosol. RanGTP-importin beta was detected using fluorescence resonance energy transfer (FRET). Control or RanBP1 siRNA were transfected into HeLa cells expressing YIC FRET sensor and histone H2B-cherry variant of GFP. Cells were imaged live to detect YIC and condensed chromosomes. FRET was carried by photobleaching YFP in the cell and imaging the enhanced CFP fluorescence (color code ranging from blue to red with red indicates the highest FRET). (4C) RanBP1 reduction disrupts spindle assembly. siRNA-treated cells were stained by DAPI (blue) and tubulin antibody (green). Prometaphase cells with either normal or defective (many small MT asters) MT structures are shown. Shown are cells with defective MT structures that exhibit either no or extensive membrane blebs. Quantifications of the phenotypes are on the right. (4D) RanBP1 reduction causes mitotic cell death. HeLa cells expressing histone H2B-GFP were treated with either control or RanBP1 siRNA for 18 hours and then recorded by time-lapse microscopy for 18 hours. Shown are phase contrast and the corresponding fluorescence images at the indicated time frames (hr:min:sec). Percentages of cells that divided, died in mitosis, died in cytokinesis, or died in interphase were quantified (graph at right). Error bars in all the histograms represent standard deviation from at least three independent experiments. More than 100 mitotic cells were counted in each of the experiments. Scale bars, 10 μm.

FIG. 5: Effects of increasing concentrations of Sox2 or Oct4 on the assembly of mitotic spindle and spindle matrix. Purified glutathione S-transferase (GST), GST-Sox2, or GST-Oct4 fusion proteins were added at 200-500 nM final concentrations in *Xenopus* egg extracts. AurA-beads and RanGTP were used to induce the assembly of the mitotic spindle matrix (shown in 5A as green lamin B3 staining) or mitotic spindle (shown in 5B as red rhodamine label of microtubules). As compared to GST control, addition of either GST-Sox2 or GST-Oct4 significantly slowed down the assembly of both the mitotic spindle and spindle matrix. The images shown are at an early time point when the GST control reactions had assembled spindles and spindle matrix, while reactions containing GST-Sox2 or GST-Oct4 had only assembled microtubule asters and no spindle matrix. This slowed assembly of spindle and spindle matrix was not observed when equal concentrations of GST-Sox2 and GST-Oct4 were added together. Scale bar, magnetic beads, 2.8 μm.

FIG. 6: Effects of mutant LB3 proteins to disrupt mitotic spindles and LB3-matrices. (6A) Purified LB3 and mutant LB3 proteins were analyzed by SDS-PAGE and Coomassie blue staining. (6B) Effects of mutant LB3 to disrupt spindle assembly induced by *Xenopus* sperm chromatin. Examples of normal and defective spindles or MT asters are shown. The graph shows the quantification of different MT structures under the indicated conditions. (6C) Effects of mutant LB3 proteins to disrupt spindle assembly induced by AurA-beads and RanGTP. Examples of normal and defective spindles as well as MT asters are shown. The graph at the bottom shows the quantification of different MT structures under the indicated conditions. (6D) Effects of mutant LB3 proteins to disrupt the assembly of LB3-matrices around AurA-beads. Spindle assembly was induced with AurA-beads plus RanGTP in the presence of buffer, wild-type, or mutant LB3. MTs were depolymerized and LB3-matrices were detected using LB3 antibody. Examples of beads with associated LB3-matrices are shown. The graph on the right shows the quantification of AurA-beads associated with LB3-matrices under the indicated conditions. Scales: white bar, 10 μm; magnetic beads, 2.8 μm.

FIG. 7: AurA-beads nucleate microtubule asters and significantly speed up spindle assembly as compared to XMAP215-beads. AurA-beads or XMAP215-beads were added to M-phase egg extracts in the presence of RanGTP. Microtubule structures were assayed from 2 min 30 sec to 30 min after the initiation of incubation at room temperature. Examples of asters and spindles are shown (top panels). Quantification (bottom graph) shows the number of asters and spindles in 50 random fields. Spindles began to assemble in the presence of AurA-beads 2 min and 30 sec after incubation and reached the highest number of spindles by 12 min and 30 sec. However, in the presence of XMAP215, spindles began to appear by ~17 min. The images are scaled differently to accommodate the MT structures. The magnetic beads (2.8 μm) in each images serve as scale bars.

FIG. 8: Requirement of Lamin B for proper spindle assembly and function in mitosis. (8A) Immunoblotting to detect LB1, LB2, or tubulin in HeLa cells treated with control or LB siRNAs. (8B) Quantification of spindle defects in control or LB siRNA-treated cells. At least 100 mitotic cells were analyzed for each siRNA-treatment. Shown are representative quantifications of at least 6 independent experiments with two different siRNA sequences. (8C) Examples of normal and defective spindles (unfocused spindle poles or abnormal spindle lacking chromosome congression) in (8B) stained with antibodies to γ-tubulin (green) and α-tubulin (red). Defective spindles are from HeLa cells treated with LB siRNAs. (8D) Effect of depletion of LB on the timing of chromosome alignment and segregation. Control or LB siRNA-treated HeLa cells were imaged. The elapsed time from chromosome congression (the appearance of chromosomal bar) to chromosome separation in 50 to 100 mitotic cells was analyzed for each siRNA treatment. (8E) Immunodepletion and add-back of LB3. Rabbit polyclonal or mouse monoclonal antibody to LB3 were used for immunodepletion. 6His-LB3 was added back to the LB3-depleted egg extracts to a final concentration of 0.2 μM. Rabbit or mouse non-immunized IgG was used as controls. (8F) Quantification of MT structures in 50 random fields. (8G) Examples of different MT structures (red) immunostained with Eg5 antibodies (green). DNA was stained with DAPI (blue). The defective spindle, aster or half spindle shown is from LB3-depleted egg extracts. Scale bars, 10 μm.

Figure 9:
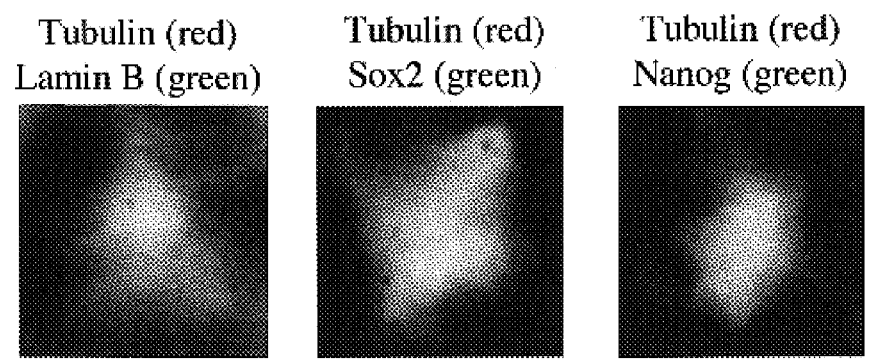

FIG. 9: Induction of mitotic spindle matrix assembly by RanGTP and AurA-beads in mouse ES cells. Mouse ES cells were arrested in mitosis using nocodazole. 70-90% mitotic arrest can be achieved after about 12 hours of nocodazole (400 nM) treatment. The ES cells were washed in PBS and the cell pellet was snap frozen in liquid nitrogen. To make the cell lysate, an energy mix, which contains 0.5 mg/ml delta 90 cyclin B, 10 mM ATP, 100 mM creatine phosphate, 0.5 mg/ml creatine kinase, that equals to 5% of the volume of the ES cell pellet was used to resuspend the ES cell pellet. A ~2-second sonication was used to disrupt the cell followed by centrifugation to make clarified and concentrated ES cell lysates. RanGTP and AurA-beads were added to the lysate to induce the assembly of mitotic spindle matrix. Shown are matrices that were double labeled with tubulin and lamin B, Sox2, or nanog. AurA-beads (2.8 μm) embedded in the matrices serve as reference for the scale.

FIG. 10: Localization of AurA to MT structures assembled in *Xenopus* M-phase egg extracts in the presence of RanGTP. (10A) Bacterially expressed and purified *Xenopus* His-AurA was visualized either by Coomassie blue staining (CB) or by Western blotting (WB) probed with the affinity-purified rabbit polyclonal antibody to the AurA protein. (10B) The rabbit antibody recognized a single band with the expected size for AurA in *Xenopus* egg extracts by Western blotting (WB). The antibody also immunoprecipitated AurA from the egg extract as judged by Western blotting probed with the monoclonal antibody (1C1) to AurA (IP/WB). (10C) M-phase egg extracts containing rhodamine tubulin were stimulated by RanQ69L, a mutant Ran mimicking RanGTP, to assemble MT asters and spindles in the presence of control buffer (control), 60 ng/ml control rabbit IgG, control secondary antibody for immunofluorescence staining (control 2° IgG), or AurA antibody (AurA IgG). MT structures were processed for immunofluorescence staining for AurA. The presence of AurA antibody during spindle assembly allowed the detection of AurA on MTs. Insets show a microtubule aster with the AurA antibody labeling the astral center. Scale bar, 10 μm. (10D) AurA antibody did not inhibit aster and spindle assembly stimulated by RanGTP. The number of MT asters and spindles was quantified from reactions shown in (10C) in 50 random fields using a 60× objective. Representative results from one of at least three independent experiments are shown.

Figure 11:
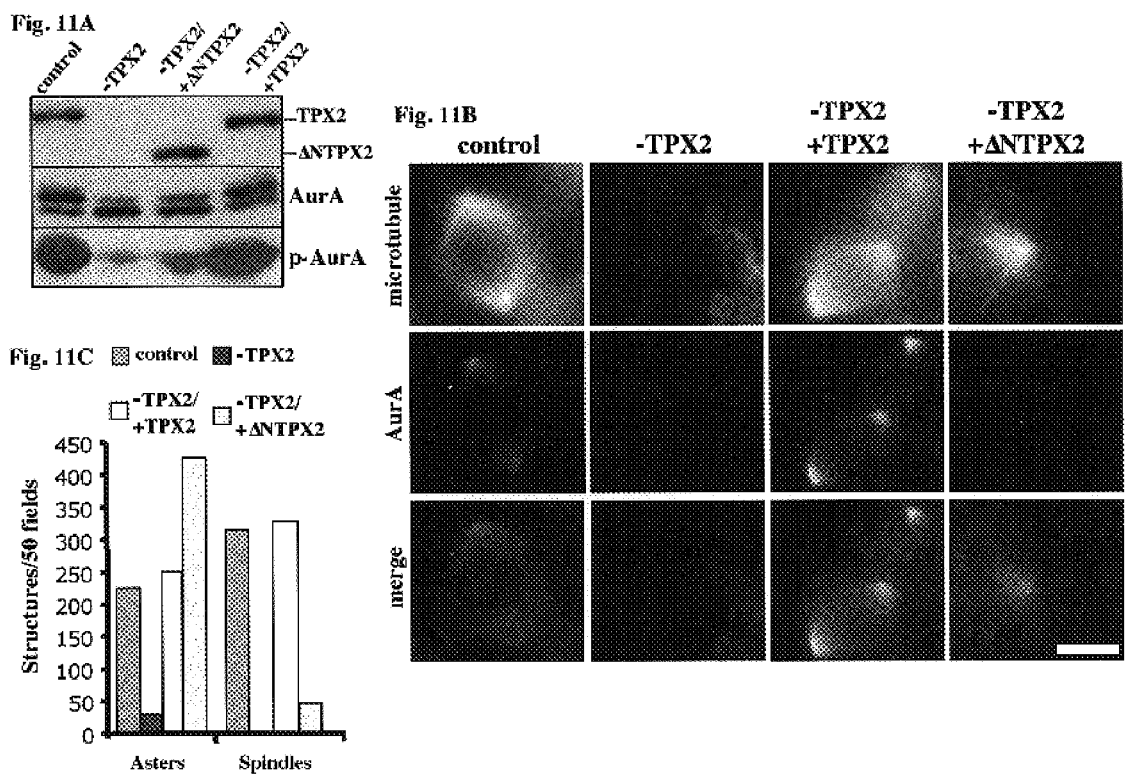

FIG. 11: AurA kinase activation by TPX2 is essential for spindle assembly stimulated by RanGTP. (11A) AurA activation by TPX2. TPX2 was depleted from M-phase egg extracts (−TPX2) followed by RanGTP stimulation with or without supplementing the extracts with purified TPX2 or ΔNTPX2. The activation of AurA was determined using a previously described antibody (p-AurA), which recognizes phospho-T295 in the activation loop of AurA. Total AurA was detected using the AurA antibody raised against His-AurA (AurA). (11B) AurA activation and spindle assembly. MT structures assembled in experiments described in (11A) were examined. Depleting TPX2 blocked the assembly of both MT asters and spindles. While TPX2 add-back rescued the formation of both spindles and asters in the depleted extracts, ΔNTPX2 add-back only rescued the formation of asters. Moreover, only TPX2 add-back restored the localization of AurA to the centers of asters. Scale bar, 10 μm. (11C) Quantification of asters and spindles in 50 random fields of the reactions in (11B). Representative results from one of at least three independent experiments are shown.

Figure 12:
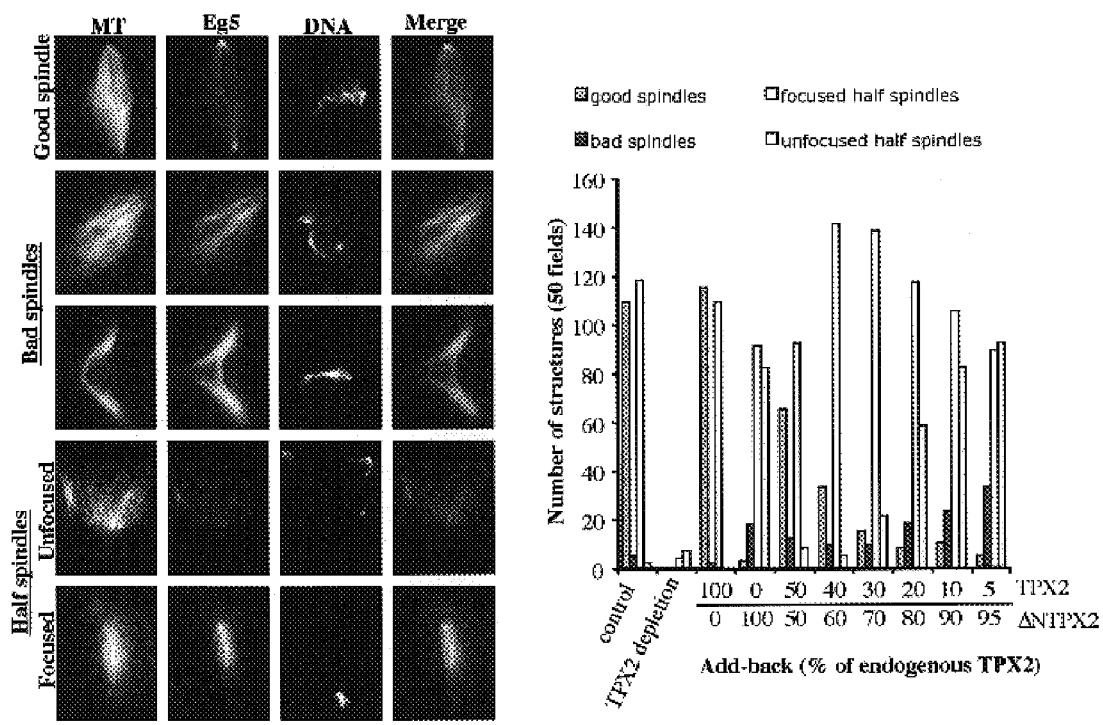

FIG. 12: The N-terminal region of TPX2 is required for spindle assembly induced by sperm chromatin in M-phase egg extracts. To determine whether TPX2 or the N-terminus of TPX2 is essential for spindle assembly, the egg extracts were immunodepleted using either TPX2 antibody (TPX2 depletion) or control IgG (control). Purified TPX2 or ΔNTPX2 was added back to the TPX2-depleted-egg extracts to the equivalent concentration (100%) of the endogenous TPX2. Different ratios of TPX2 and ΔNTPX2 added are shown (% of endogenous TPX2) below the graph on the right. Examples of good spindle, bad spindle, and half spindles are shown on the left. The spindle microtubules were visualized using rhodamine tubulin (red), while spindle poles were visualized by immunostaining with anti-Eg5 antibodies (green). Sperm chromatin was stained by DAPI (blue). It was determined that depleting TPX2 completely inhibited spindle assembly. A few microtubule structures formed in the absence of TPX2 were half spindles that had either focused or unfocused poles. Addition of purified TPX2 rescued spindle assembly to the level of control-depleted egg extracts. However, ΔNTPX2 add-back only rescued spindle assembly to ~2% of the control level. ΔNTPX2 add-back did rescue the assembly of half spindles with focused poles. Compared to mock-depletion or TPX2-depletion/TPX2 add-back, ΔNTPX2 add-back also caused an increased assembly of bad spindles and half spindle assembly that had unfocused poles. Scale bar, 10 μm.

FIG. 13: AurA-coated beads act as MTOCs in M-phase egg extracts stimulated by RanGTP. (13A) Localization of AurA antibody-coated beads to MT astral centers and spindle poles assembled in the presence of RanGTP in M-phase egg extracts. All scale bars here and below are 10 μm. (13B) The kinase activity of AurA is essential for AurA-beads to function as MTOCs. AurA-beads made by coating the AurA antibody-bound beads with either purified AurA protein or with AurA from egg extracts gave indistinguishable results. The images shown for AurA and AurA-AA (kinase-dead AurA) are from beads coated with purified AurA proteins. (13C) AurA-beads did not nucleate microtubules from purified tubulin, while XMAP215-coated-beads did. MT assembly was detected using rhodamine-labeled tubulin. MT nucleation was carried out at the indicated tubulin concentrations at 37° C. for 20 min. (13D) RanGTP stimulated the stable recruitment of microtubule-nucleating activities onto AurA-beads. AurA-beads were incubated with M-phase egg extracts under the three conditions shown. AurA-beads stimulated both aster and spindle assembly in the presence (condition 2), but not in the absence (condition 1), of RanGTP. As expected, AurA-beads incubated in the presence of RanGTP and nocodazole did not assemble MTs (condition 3). AurA-beads from conditions 1 and 3 were retrieved by magnet and washed with XB buffer. MT nucleation was carried out by incubating the beads with 20 μM pure tubulin at 30° C. for 20 min. Only AurA-beads incubated with egg extracts in the presence of RanGTP nucleated MT asters. The diameter of the beads is 2.8 μm.

FIG. 14: AurA-beads stimulate spindle assembly in the M-phase egg extracts in the presence of RanGTP. (14A) AurA-beads stimulate aster and spindle assembly. M-phase egg extracts containing beads coated with control IgG (control), AurA, AurA-AA, or XMAP215 were stimulated by RanGTP for 10 min. MT structures and beads are shown. (14B) Quantification of aster and spindle assembly. Both AurA-beads and XMAP215-beads stimulated aster assembly within 10 min, but only AurA-beads assembled spindles at this time point. Significantly fewer asters were assembled in extracts containing either control IgG-beads or AurA-AA-beads. MT asters or spindles that were either associated or not associated with beads were counted. Representative results from one of at least three independent experiments are shown. (14C) Localization of AurA-beads and XMAP215-beads on spindles. Both AurA- and XMAP215-beads were localized to the center of microtubules asters (14A). However, while AurA-beads were found at spindle poles, XMAP215-beads were localized along the spindle. Neither control IgG-beads nor AurA-AA-beads showed specific localization to the microtubule structures. (14D) Quantification of bead localization along spindles. Each spindle was divided into a, b, and c areas as shown. The percentage of beads with localization in these areas was quantified. Representative results from one of at least three independent experiments are shown. (14E) Quantification of bead number per aster or per spindle. Asters with either no bead or one bead per astral center were quantified. Spindles with one bead at only one of the two poles (one bead) or one bead at each of the two poles (two beads) were quantified. Representative results from one of a minimum of three independent experiments are shown.

FIG. 15: The MTOC function of AurA-coated beads depends on both MT nucleators and MT-based motors. (15A) Immunodepletion of TPX2 or γ-tubulin from the M-phase egg extracts. Controls were immunodepletions carried out with non-immunized rabbit IgG. (15B) Immunodepletion of either TPX2 or γ-tubulin significantly affected the ability of AurA-beads and XMAP215-beads to nucleate MT in the presence of RanGTP. Scale bars here and below are 10 μm. (15C) Quantification of beads that were not associated with MTs. Immunodepletion of either TPX2 or γ-tubulin increased the number of MT-free AurA- or XMAP215-beads. This effect was more pronounced on the AurA-beads than on the XMAP215-beads. Representative results from one of at least three independent experiments are shown. (15D) Inhibition of Eg5 or dynein using Monastrol or 70.1 antibody, respectively, completely disrupted spindle assembly in extracts containing AurA-beads. MT-free beads were quantified. Monastrol (MA), but not 70.1 antibody, significantly increased the percentage of MT-free AurA-beads. Neither Monastrol nor 70.1 antibody greatly affected the ability of XMAP215-beads to nucleate MT asters. Representative results from one of at least three independent experiments are shown.

FIG. 16: Requirement of LB3 for the assembly of LB3-matrices that contain SAFs. (16A) Similarity of LB3-matrices and SAF-matrices. Spindle assembly was induced with AurA-beads and RanGTP. After MT depolymerization, the remaining structures were immunostained with antibodies to LB3, PAR, NuMA, Eg5, XMAP215, or TPX2. Rhodamine tubulin was used to label MTs. (16B) Quantification of LB3- or SAF-matrices in 50 random fields from (16A) that were associated with 0, 1, 2, or more than 2 beads. (16C) Presence of SAF in LB3-matrices. LB3-matrices were assembled with AurA-beads and RanGTP in the absence of MT assembly and double immunostained for SAFs (XMAP215, Eg5, or NuMA in green) and LB3 (red). The graph shows the quantification of LB3, NuMA, PAR, XMAP215, Eg5, and TPX2 positive matrices associated with 0, 1, 2, or more than 2 AurA-beads in 50 random fields. (16D) Requirement of LB3 for the assembly of matrices containing Eg5 and NuMA. Egg extracts were first immunodepleted of LB3, Eg5, or XMAP215 with their respective antibodies and then incubated with sperm chromatin. After depolymerization of MTs, the sperm chromatin was stained with DAPI (blue) and antibodies to LB3, Eg5, or NuMA (green). Rhodamine-tubulin was used to label MTs (red). The percentage of sperm chromatin with associated matrices that contain LB3, Eg5, or NuMA were quantified. When either Eg5 or XMAP215 was depleted from the egg extracts, associations of NuMA, Eg5 (XMAP215 depletion), or LB3 with sperm chromatin as matrices were similar. However, when LB3 was depleted, neither LB3 nor NuMA and Eg5 associated with sperm chromatin as matrices. Shown is a typical graph quantifying the association of LB3-matrix with sperm chromatin. Scales: white bars, 10 µm; magnetic beads, 2.8 µm.

FIG. 17: Isolated LB3-matrices nucleate MT assembly. (17A) Isolation of LB3-matrix. AurA-beads and RanGTP were used to induce spindle assembly in egg extracts (a). Spindles were separated from the egg extracts either by centrifugation through a glycerol cushion onto coverslips (b) or retrieved with a magnet (c). The magnet-retrieved spindles were washed with buffer containing nocodazole. LB3-matrices were retained on the beads (d). To separate the LB3-matrices from the beads, the sample was pipetted repeatedly. Beads (e) were then retrieved with a magnet, leaving LB3-matrices (f) in the supernatant. Scale bar, 10 µm. (17B) Commassie blue staining of the samples described in (17A). 1 µl of egg extracts, or the equivalent of 5, 30, 120, 600, or 600 µl of extract was loaded in lanes a, b, c, d, e, or f, respectively. (17C) Western blotting of the samples in (A) with antibody to PAR. Similar amounts of materials were loaded as in (17B), except in lanes e and f where only the equivalent of 120 µl of the extracts was loaded in each lane. (17D) Western blotting of the samples in (17B) with antibody to tubulin, TPX2, Eg5, XMAP215, or LB3. (17E) Isolation of LB3-matrices from mock-depleted or XMAP215-depleted egg extracts. Top, isolated LB3-matrices (green) with little tubulin (red). Bottom, isolated LB3-matrices (green) from the XMAP215-depleted egg extracts without XMAP215 (red). Scale bars, 5 µm. (17F) MT assembly induced by isolated LB3-matrices. The LB3-matrices isolated as described in (17E) were used in MT assembly assays using pure tubulin. LB3-matrices, green; MTs, red. The graph at the bottom shows the quantification of matrices that nucleated MTs. Scale bar, 10 µm.

Table 1: This table lists the proteins that were found to associate with the isolated mitotic spindle matrix using mass spectrometry. The mitotic spindle matrix was isolated from *Xenopus laevis* egg extracts. The table lists the accession numbers for each protein in *Xenopus laevis, Xenopus tropocalis*, or its homolog in organisms that has gene annotations.

DETAILED DESCRIPTION OF THE INVENTION

Preparation and Isolation of Mitotic Spindle Matrix

The present invention discloses the identification and isolation of the mitotic spindle matrix utilizing concentrated lysates made from eggs, embryos, or tissue culture cells, including embryonic or adult stem cells. The membranous-lamin-based mitotic spindle matrix is essential for cell division and cell differentiation. It can be used to assay for agents that modulate the potential of cell division and/or cell differentiation. In one embodiment, Aurora A kinase can be used to isolate and prepare the mitotic spindle matrix. In this embodiment, Aurora A kinase is coated onto magnetic beads and added to the lysates in the presence of RanGTP. The beads are retrieved using magnet and washed. These beads are associated with a membranous-lamin-based assemblage. In another embodiment, biotinylated chromatin can be used to isolate the same matrix. Since chromatin can generate RanGTP, it is possible to omit the exogenously added RanGTP in this embodiment. In a further embodiment, RanGTP can be increased by either down-regulating the RanGTPase (RanGAP) activity or by up-regulating the activity of guanine nucleotide exchange factor (GEF) for Ran.

The Biochemical Properties of the Mitotic Spindle Matrix

The mitotic spindle matrix can assembly either in the presence or absence of microtubules, but it requires the signaling pathways such as those mediated by the RanGTPase (FIG. 1A). If microtubules are allowed to polymerize, a much more robust mitotic spindle matrix can be assembled (FIGS. 1B and C). The matrix assembly is completely inhibited by detergent (FIG. 2) and nuclear transport receptors (FIG. 3), which in turn inhibits spindle assembly and cell division. It was determined that a component of the mitotic spindle matrix has at least one of the following roles: spindle assembly, microtubule nucleation, chromosome segregation, regulating the timing of spindle assembly and mitotic progression, cell differentiation, or apoptosis. Therefore, the mitotic spindle matrix not only orchestrates cell division but also directs the organization and fates of daughter cells.

Disclosed herein is that this mitotic spindle matrix contains an assembled form of lamin, membranes, actin, spindle assembly factors (Eg5, XCTK2, XMAP215, NuMA, PAR, Survivin, Aurora B, INCENP), transcription factors (Sox family and Oct family of transcription factors, Brachyury-like T-box transcription factor, Myb, and Myc), chromatin remodeling complexes (Brg complex), components of the endocytic pathway (clathrin and eps15), components of the ubiquitination system (FAM and p97-Ufd1-Npl4), components of the translational machinery, etc (see Table 1). A large number of these components are essential for spindle morphogenesis and chromosome segregation and they further determine the kinetics of cell division and the cell fates after cell division.

The Utility of the Mitotic Spindle Matrix

Identification of agents that have therapeutic values for human disease requires powerful biochemical assays that mimic the in vivo cellular processes. Most current assays are overly simplified, therefore limiting the scope and utility of agents that are identified. The present invention provides an advancement that overcomes the current limitations of drug identification process. Examples of three utilities of the mitotic spindle matrix in drug discovery are described below.

a. Identification of Agents that Arrest Cancer Cells and Induce Their Death.

Most current screens used to identify anti-cancer drugs are based on assays for microtubule assembly or activities of known spindle assembly factors. Although chemicals that inhibit cancer cell proliferation have been discovered and some of them, such as taxol, are useful in cancer chemotherapy, the major limitation of these agents is that they inhibit cancer cell division by arresting them in mitosis. Prolonged mitotic arrest can eventually lead to cell death of many tumor cells. However, subpopulations of tumor cells do overcome the arrest. A fraction of these cells acquire and accumulate new mutations that allow them to proliferate aggressively and become insensitive to the drug treatment, which has been the major limitation of currently available cancer chemotherapy. Much more effective agents for cancer therapy would be those that simultaneously arrest cells in mitosis and induce their death without prolonged cell cycle arrests. However, despite extensive effort, no such chemicals have been identified because most strategies used in screening anti-cancer agents either rely on overly simplified assays of individual protein activities in vitro or assaying for mitotic arrests in live cells. Since proper assembly of the mitotic spindle matrix is essential for not only mitosis but also cell survival, assaying for both spindle matrix assembly and microtubule polymerization offer the opportunity to identify agents that would both arrest and kill the highly proliferative cancer cells. Indeed, disruption of spindle matrix assembly in HeLa cells disrupts microtubule polymerization and causes rapid cell death in mitosis (see Example 1 and FIG. 4).

b. Identification of Agents that Modulate Cell Differentiation

Embryonic and adult stem cells hold great promise in cell-based treatment of human diseases. However, one of the biggest challenges in harnessing the differentiation potential of stem cells is identifying agents that can induce stable and uniform differentiation of stem cells into a given tissue. As disclosed herein, transcription factors and chromatin remodeling complexes that regulate cellular pluripotency and differentiation are components of the mitotic spindle matrix and they regulate the function of spindle matrix. Since these factors is essential for modulating stem cell differentiation, by assaying the assembly and function of mitotic spindle matrix and the association of transcription factors and chromatin remodeling complexes to the matrix, our invention offers a novel approach to identify agents that can modulate stem cell differentiation (see Example 2 and FIG. 5).

c. Identification of Agents that Promote Cell Proliferation

Abnormally slow or cessation of cell proliferation characterizes both natural and premature aging. Defects in lamin have been shown to cause premature aging in the group of diseases called laminopathy [35]. However, very little is known about the disease mechanism. Consequently, no effective treatment has been developed. The isolation of lamin-based spindle matrix offers a unique angle to identify agents that modulate mitotic lamin assembly during cell division. These agents can be further explored for therapeutic intervention. As an example, it is shown that lamin mutants disrupt the assembly of the spindle matrix, leading to defects in mitotic spindle assembly (see Example 3 and FIG. 6).

Screening Method

The present invention also provides methods of utilizing concentrated lysates made from eggs, embryos, or tissue culture cells to identify signal pathways of cell division and/or cell differentiation, and to screen for agonists and antagonists of these pathways. The invention is based upon a novel assay for microtubule nucleation, spindle formation, lamin and membrane-based assembly of mitotic spindle matrices. Such methods include comparison to a control to compare the effect of the agent to a known inhibitor or activator of a cell division and/or cell differentiation signaling pathway, including inhibitors and/or activators of spindle formation, MT nucleation, lamin and membrane-based spindle matrix assembly, translational control in mitosis, post-translational modifications in mitosis.

In one embodiment, a plurality of beads coated with one or more than one signaling molecules involved in a cell division and/or differentiation signaling pathway is used to assay spindle formation, MT nucleation, and/or lamin and membrane-based matrix assembly in the lysates of choice. The localization of these beads on spindles, MTs, and/or lamin-matrix is determined. The effect of these beads on spindle, MT, and/or lamin-matrix assembly can also be measured. In some embodiments, the beads are magnetic beads and/or quantum dots.

In another embodiment, the agent is included with a plurality of magnetic beads and/or quantum dots in a lysate of choice, each of said plurality of beads or dots coated with at least one protein in the presence or absence of said agent; and the effect on spindle formation, MT nucleation, and/or lamin and membrane-based matrix assembly as well as the effect on the localization of the molecule-coated beads is determined and/or measured, wherein the change in spindle formation, MT nucleation and/or lamin and membrane-based matrix assembly as well as the change of bead localization compared to a control indicates an agent capable of modulating a cell division and differentiation signaling pathway.

In a further embodiment, the molecule-coated magnetic beads can be used to isolate spindles, MTs, and lamin/membrane-matrix. Applicants have determined that magnetic beads coated with Aurora A kinase, a mitotic kinase essential for spindle assembly, enhances MT nucleation and spindle assembly in the presence of RanGTP by shortening the time required by at least three fold (FIG. 7). It is further disclosed the discovery of a lamin/membrane-based spindle matrix that is essential for spindle assembly (FIG. 8). Finally, lysates made from mammalian tissue culture cells such as the embryonic stem cells can also be used for assaying the assembly of the mitotic spindle matrix (FIG. 9).

Using the methods of the invention, specific proteins, mRNAs, and/or microRNAs that are involved in regulating the cell division and/or cell differentiation pathways could be identified without the need for carrying out other more extensive procedures. The methods for assaying cell division and/or differentiation signaling pathways described herein provide a facile means for identifying or screening selective modulators (i.e., activators and/or inhibitors) of proteins, mRNAs, and microRNAs. Upon exposure of selective modulators to the lysates, the altering of spindle formation, MT nucleation, or lamin and membrane-based matrix assembly, or the altering of association of proteins, mRNAs, and microRNAs with MTs and/or lamin and membrane-based matrices would indicate the perturbation of the cell division and or cell differentiation signaling pathways. The present invention thus takes advantage of the effect of selective modulation of signaling protein on spindle formation, MT nucleation and/or lamin assembly to identify its critical role in a cell division and/or cell differentiation signaling pathway because each of spindle formation, MT nucleation and/or lamin/membrane assembly is a critical event in the cell division and/or cell differentiation pathways.

In practicing the methods of the invention, it is not necessary that the identities of the particular cell division signaling and/or cell differentiation pathways are characterized or known, for example, the particular gene transcripts or expressed proteins, as the instant method relies upon the alterations in the patterns of such cell division and/or cell differentiation signaling pathways and not their identities. Knowledge of these identities may provide additional confirmation as to the role or function of the signaling protein being modulated.

As mentioned above, the effect on spindle formation, MT nucleation and/or lamin-membrane matrix assembly described herein can be correlated among several conditions and optional controls in which the outcome is the pattern of changes that are attributable to the selective modulation of the signaling agents of interest. The changes may be increases or decreases in the activity of a particular cell division and/or cell differentiation signaling pathways attributable to the inhibition of the particular signaling protein. Furthermore, the absence of a change in a particular cell division and/or cell differentiation signaling pathway may also be included among the controls. A significant alteration that may be considered an effect contributing to the pattern is dependent upon the particular cell division and/or cell differentiation signaling pathway being measured, whether the measurement is qualitative or quantitative, and the reproducibility of measurement and other factors. Typically, in a specific, reproducible and quantitative measurement, a change of about 1.5-fold to about 2-fold increase or decrease (including appearance or disappearance or kinetics) of spindle formation, MT nucleation, and/or lamin/membrane assembly, the association of proteins, mRNA, and/or microRNA with the spindles, MT, and/or lamin-membrane-matrices is considered a change resulting from the specific inhibition of the signaling protein. The identities of the particular elements of the cell division signaling pathways need not be determined, for example, the particular gene transcripts, proteins, or microRNA whose levels are altered. A skilled artisan will be aware of the variations in the measurement methods and the factors which must be considered in attributing the extent of change, or lack of a change, to a specific effect on spindle formation, MT nucleation and/or lamin-membrane assembly.

As noted above, the present invention has two broad aspects. In the first aspect, a method is provided to identify the role of one or more signaling proteins, transcript, or microRNA in one or more cell division and/or cell differentiation signaling pathways. In the second, the aforementioned method is utilized in identifying specific modulators (i.e., agonists or antagonists).

The method of the present invention for identifying the role of a signaling protein, transcript, and/or microRNA in a cell division and/or cell differentiation signaling pathway or agents which modulate a signaling protein, transcript, and/or microRNA is carried out by any of the following general procedures described herein. Various steps may be modified to achieve the same goal, such modifications will be readily apparent to the skilled artisan. To identify a pattern of cell division and/or cell differentiation signaling pathways attributable to the selective inhibition of a wild-type form of a preselected signaling molecule the following steps may be carried out. The order in which the steps is carried out is important insofar as steps requiring the products of previous steps must await the preparation of the required products. Certain steps are optional, these steps providing additional comparisons to increase the discriminatory ability of the method. As will be noted below, such additional steps increase the time required for the test, but increase the power to identify selective inhibitors or activators. Such additional steps may be excluded for high throughput screening, the steps added for increasing the discrimination.

First, one or more proteins, RNA, and/or lipids, referred to herein as the preselected signaling molecule, are coated on a plurality of beads, including magnetic beads and differentially colored quantum dots. If more than one molecule is used, they should be coated to different beads or dots to allow differentiation. A very large number of such signaling proteins are known, and have been identified as being involved in a number of important cellular pathways. Examples include, but are not limited to, kinases (such as Aurora A kinase, Aurora B kinase, polo kinase, Nek kinase, GSK3beta, CKII, mTor, PI3 kinase), phosphatases (such as PPI, PPIIA, PPIIB), cytoskeleton proteins (such as lamin B, lamin A, vimentin, actin, tubulin, TPX2, XMAP215, gamma-tubulin ring complex, Maskin), motor proteins and their regulators (such as dyneins, kinesins, myosins, dynactin, NudE, Nudel), regulators of dyneins or kinesins, chaperones (such as Hsp90, Hsp70, p97-Ufd1-Npl4), ubiquitination enzymes such as SCF and APC/C, deubiquitination enzymes (such as FAM), transcription factors (such as beta-catenin, Oct4, Sox2, and nanog), transcriptional regulators (such as p53, pRB, p300, histone acetylation or deacetylation enzymes, histone methylase or demethylase, SWI/SNF, NuRD), Caspases, G-proteins, regulators of G-proteins, growth factors, growth factor receptors, membrane associated proteins involved membrane remodeling and trafficking (such as clatherin, epsins, epsin related proteins), translational regulators (such as proteins involved in cytoplasmic polyadenylation, translation initiation proteins). RNA can be either coding or non-coding RNAs (such as mRNA, microRNA, tRNA, rRNA). As optional negative controls, uncoated beads or dots, or beads or dots coated with inactive proteins such as the Aurora A with a mutation in the catalytic domain of the kinase can be used.

The above beads are then contacted with the lysates made from oocytes, embryos, cultured cells, and/or tissues. The oocytes and embryos can come from animal source. The cultured cells include but not limited to embryonic stem cells, any established animal or plant cells. The cultured cells can also be engineered to express any labeled protein or mutant or wild-type signaling molecules. Tissues include animal or plant tissues. Several general methods can be used to disrupt the cells or tissues, including but not limited to sonication, French press, and homogenization.

Next, spindle, MTs, and lamin-matrix will be allowed to assemble by addition of purified GTP-bound Ran. The location of the magnetic beads and/or quantum dots on the assembled structures will be determined. Moreover, whether the beads or dots are associated with both MTs and lamin-matrix or only with MTs can be determined. Association of the beads or dots with MTs and/or lamin-matrix would indicate the coated protein could be involved in regulating cell division and/or the cell differentiation.

In another step, the structure with associated magnetic beads can be retrieved using magnet. The retrieved material can be subjected to partial purifications. The partial purification includes repeated washes with selected buffers to remove loosely associated materials. The buffers can also include chemicals that depolymerize either MTs or lamin-matrix. Proteins, lipids, mRNA, and microRNA can be extracted from the materials remained on the beads and identified using existing methods that can be carried out by a skilled artisan. The existing methods include mass spectroscopy, lipid chromatography, protein and DNA microarray technologies. Molecules identified in this manner (but are not found in the optional parallel control reactions) could be involved in regulating cell division and/or cell differentiation.

The above retrieved material can also be used for various enzymatic assays, including but not limited to kinase, phosphatase, acteylase/deacetylase, methylase/demethylase, mRNA polyadenylation, protein translation, MT nucleation. The above assays can also be carried out in the presence or absence of an agent. The agent can be chemicals, proteins, polypeptides, lipids, nucleic acids. The agent can be one that is known or suspected to selectively inhibit or activate a cell division or cell differentiation pathway. The agent can also be a chemical library. If the assays are carried out in the presence or absence of an agent, the outcome of the assays in the presence or absence of the agent will be compared. The following changes would indicate that the agent is involved in a cell division and/or cell differentiation pathway: the change of assembly pattern of spindle, MT, or lamin-membrane-matrix; the change of bead association pattern with spindle, MT, and/or lamin-membrane-matrix; the change of proteins, lipid, mRNA, and/or microRNA that are extracted from the magnet-retrieved structures as assayed by mass spectroscopy, lipid chromatography, protein and DNA microarray technologies; the change of enzymatic activities.

Methods of Treatment

This invention includes methods for the treatment of a disorder (i.e., disease) associated with a cell division signaling pathway in a mammal, including a human, comprising administering to said mammal an agent identified by the methods of the invention, or a pharmaceutical composition comprising an agent identified by the methods of the invention, that is effective in modulating (i.e., inhibiting or activating) a cell division signaling pathway associated with the disorder, without the addition of other therapeutic agents. In one embodiment of this method, the disorder includes, but not limited to, a proliferative or aging disease. In some embodiments, the proliferative disease is selected from the group consisting of cancer and blood vessel proliferative disorders. In a further embodiment, the cancer is selected from the group consisting of squamous cell carcinoma, astrocytoma, Kaposi's sarcoma, glioblastoma, multiple myeloma, lung cancer, bladder cancer, head and neck cancer, melanoma, ovarian cancer, prostate cancer, breast cancer, small-cell lung cancer, glioma, colorectal cancer, genitourinary cancer, gastrointestinal cancer. In yet a further embodiment, the blood vessel proliferative disorder is selected from the group consisting of diabetic retinopathy, age-related macular degeneration, retinopathy of prematurity, arthritis and restenosis. In some embodiments, the aging disease is laminopathy or progeria.

This invention also includes methods for the treatment of any of the above cell division signaling pathway disorders which comprises administering to said mammal, including a human, a pharmaceutical composition comprising an amount of an agent that identified by the methods disclosed herein that is effective in inhibiting abnormal cell growth. This includes the abnormal growth and/or proliferation of cancer cells including benign and malignant cells of neoplastic diseases. Inhibition of abnormal cell growth can occur by a variety of mechanism including, but not limited to, inhibition of cell division associated with spindle formation, MT nucleation and/or lamin matrix assembly, cell death, apoptosis, transcription, translation, transduction, etc.

In practicing the methods of this invention, the agents may be used alone or in combination with other inactive ingredients. The methods of the invention therefore include administration of an agent linked to a cytotoxic agent for the treatment of a disease associated with abnormal activity of a cell division and/or cell differentiation signaling pathway. Examples of cytotoxic agents include, but are not limited to, gelonin, ricin, saponin, pseudonomas exotoxin, pokeweed antiviral protein, diphtheria toxin, complement proteins, or any other agent known in the art which is capable of killing a cell upon contact with that cell.

The compositions and methods of the invention can be utilized in vivo, ordinarily in mammals, such as humans, sheep, horses, cattle, pigs, dogs, cats, rats and mice or in vitro. The invention is particularly useful in the treatment of human subjects.

The following working examples specifically point out specific embodiments of the present invention, and are not to be construed as limiting in any way the remainder of the disclosure. Other generic configurations will be apparent to one skilled in the art. All references, including U.S. or foreign patents, referred to in this application are herein incorporated by reference in their entirety. Furthermore, this application incorporates U.S. provisional application 60/735,168 and the scientific articles containing the content of said provisional application by reference in their entirety.

EXAMPLES

Example 1

Induction of Mitotic Cell Death in HeLa Cells by Disrupting Mitotic Spindle Matrix To disrupt the assembly of mitotic spindle matrix in HeLa cells, RanGTP-importin beta concentration was elevated throughout the mitotic cell by reducing the level of RanBP1, a Ran binding protein known to dissociate RanGTP from importin beta and stimulate RanGTP hydrolysis into RanGDP [36]. To accomplish this, HeLa cells were treated siRNA targeted to RanBP1 or control siRNA targeted to luciferase. A reduction of 75-90% of RanBP1 protein level is routinely achieved (FIG. 4A). RanGTP-importin beta levels were measurements using a Fluorescence Resonance Energy Transfer (FRET) sensor called YIC [37, 38]. As expected, a high concentration of RanGTP-importin beta was detected on the condensed mitotic chromosomes in cells treated with control siRNA. However, in cells treated with RanBP1 siRNA, a high RanGTP-importin beta concentration was detected throughout the mitotic cytosol (FIG. 4B). This excessive production of RanGTP concentration led to aberrant assembly of both microtubules and mitotic spindle matrix in cells with reduced RanBP1 (FIG. 4C). As a result, cells treated with RanBP1 siRNA underwent extensive mitotic cell death (FIG. 4D). This example shows that by simultaneously disrupting microtubules and the spindle matrix, it is possible to kill cells undergoing mitosis.

Example 2

Changing the Levels of Sox2 and Oct4 Influences the Assembly of Both Mitotic Spindles and the Spindle Matrix The mitotic spindle matrix was identified to contain transcription factors important for both maintaining stem cell pluripotency and differentiation (Table 1). Here, it is demonstrated that two such transcription factors, Sox2 and Oct4, which are known to regulate embryonic stem (ES) cell pluripotency and differentiation, can modulate the assembly of the mitotic spindle and spindle matrix. A balanced level of Sox2 and Oct4 is essential for maintaining the pluripotency of ES cells. Elevating one of these factors over the other leads to differentiation of ES cells into specific tissues. However, it is not clear what triggers such changes of Sox2 or Oct4 expression during ES cell differentiation. Moreover, how changes in Sox2 and Oct4 proteins lead to ES cell differentiation remains unknown. Therefore, it has not been possible to identify agents that could be used to induce ES cell differentiation by inducing the change of expression of Sox2 and Oct4. Addition of either bacterially expressed and purified Sox2 or Oct4 caused significant delay in the assembly of both the spindle and spindle matrix (FIG. 5). This finding provides an example of identifying agents that modulate cell differentiation by assaying the change of assembly kinetics of mitotic spindle/spindle matrix.

Example 3

The Requirement for Proper Assembly of Lamin B-Matrix in Spindle Formation

As shown in FIG. 8, immunodepleting lamin B in either HeLa cells or in *Xenopus* egg extracts severely inhibits spindle assembly and prevents the assembly of lamin B-matrices, further studies were carried out to see whether perturbing the structural integrity of the mitotic lamin B-matrix would also disrupt spindle assembly. Previous studies have shown that both the N- and C-termini of lamin B are required for the assembly of the protein into filaments in vitro [39]. To disrupt proper assembly of the mitotic lamin B-matrix, three mutant forms of lamin B3 (LB3, the major form of lamin B found in *Xenopus* eggs) were used, called ΔNLB3, LB3T, or LB3T-nls. These LB3 mutants could disrupt the organization of interphase nuclear lamina and proper nuclear structure and function [40]. ΔNLB3 lacks the N-terminal 32 amino acids of LB3 (583 amino acids in length). LB3T contains the last 200 amino acids of LB3, whereas LB3T-nls is made from LB3T by mutating the nuclear localization signal of the protein so that LB3T-nls does not bind to importin alpha. Wild-type and mutant LB3 proteins were expressed and purified from bacteria as 6His fusion proteins.

Xenopus sperm or RanGTP plus AurA-beads were used to stimulate spindle assembly in the presence of the LB3 variants at concentrations that could disrupt nuclear lamina assembly and nuclear function [40]. All three LB3 mutant proteins severely disrupted spindle assembly, whereas neither buffer control nor wild-type LB3 affected spindle assembly (FIG. 6).

Example 4

Creation of Anti-Aurora A (AurA) Antibodies

Rabbit polyclonal antibody to AurA was produced with His-tagged AurA expressed in bacteria [30, 32]. The antibody was affinity purified against the same AurA protein. The AurA antibodies produced from four different rabbits had the same ability to make AurA-beads that were competent for MT nucleation and spindle assembly. The antibodies against the following proteins have been described previously: AurA (ICI) [30], XMAP215 [25], TPX2 [30], gamma-tubulin [41], Eg5 [24], and dynein (Sigma). The magnetic beads (2.8 μm) are protein A-coated (Dynal Biotech). M-phase egg extracts were made as in [30].

Example 5

Preparation of Magnetic Beads

To prepare the beads, 10 μl of the slurry ($2 \times 10^9$ beads/ml) was washed with XB buffer (10 mM Hepes, pH 7.7, 50 mM sucrose, 100 mM KCl, 0.1 mM $CaCl_2$ and 5 mM EGTA). The beads were retrieved using magnet and then incubated with 10 μg of antibodies for one hour in 50 μl TBS. The beads were washed with XB buffer to remove unbound antibodies. To coat the beads with AurA, beads coated with AurA antibody were incubated with 100 μl of purified AurA or AurA-AA at a final concentration of 1 mg/ml for one hour at 4° C. Alternatively, the beads were incubated with 100-500 μl of M-phase egg extracts for one hour at 4° C. To coat the beads with XMAP215 (a microtubule binding protein), beads coated with XMAP215 antibody were incubated with 100 μl M-phase egg extracts for one hour at 4° C. After incubation, the beads were washed with XB buffer at 4° C. and then resuspended in 10 μl of XB buffer. This bead suspension was diluted 200 to 400 fold in egg extracts for MT assembly assays.

Since AurA-beads shortened the time necessary for spindle assembly, the reactions containing AurA-beads were generally incubated for 5 to 15 minutes at room temperature, while reactions containing XMAP215-beads or other control beads were carried out for 5 to 45 minutes at room temperature. The precise time of incubation was empirically determined for each egg extract.

Example 6

In the Presence of RanGTP, Aurora A Localizes to Spindle Poles and Microtubule Astral Centers Xenopus egg extracts made from cytostatic factor arrested mature oocytes (M-phase extracts) offer a great in vitro system to study the assembly of centrosomes and spindles in mitosis. The use of this system has led to many discoveries, including the signaling pathway mediated by RanGTPase that stimulates spindle assembly in mitosis [29, 42]. However, the inability to detect the localization of AurA on centrosomes and spindles assembled in egg extracts and the lack of good functional assays for AurA have made it difficult to study the function of the kinase in the egg extracts [43].

To overcome these problems, rabbit polyclonal antibodies against Xenopus AurA (also called Eg2) were generated (see Example 4 above). The affinity-purified AurA antibody recognized AurA in egg extracts both by Western blotting and by immunoprecipitation (FIGS. 10A and B). Although this antibody recognized AurA at centrosomes and spindle poles in Xenopus tissue culture cells by immunostaining, it failed to detect AurA at the poles of spindles induced by RanGTP in Xenopus M-phase egg extracts (FIG. 10C). It was reasoned that spindles assembled in the egg extracts might have denser MTs than that of tissue culture cells, which could physically block AurA antibody to access AurA on spindle poles. Since the antibody recognized native AurA by immunoprecipitation, a small amount of antibody (60 ng/ml final) was added to M-phase extracts prior to the induction of aster and spindle assembly by RanGTP. The MT structures were then processed for immunofluorescence staining as described previously [25]. This treatment allowed detection of the highly concentrated AurA at the centers of MT asters and spindle poles (FIG. 10C). Quantification revealed that the low level of AurA antibody used during MT assembly did not inhibit aster and spindle assembly as compared to controls (FIG. 10D). This shows that AurA is concentrated at MT spindle poles and MT astral centers assembled in egg extracts.

Example 7

AurA Activation Mediated by TPX2 is Required for Spindle Assembly by RanGTP

The ability to detect AurA on MT structures assembled in Xenopus egg extracts allowed further exploration of the function of this kinase. Previously, it was demonstrated that TPX2 is essential for the activation of AurA by RanGTP in M-phase egg extracts [44]. Since the addition of mutant AurA-T294, 295A (AurA-AA), which does not have kinase activity, greatly inhibited spindle assembly induced by RanGTP in M-phase extracts, it was proposed that AurA kinase activation through TPX2 is important for spindle assembly stimulated by RanGTP [44]. However, a recent study showed that the C-terminal region of TPX2, which does not bind or activate AurA, is sufficient to replace the endogenous TPX2 for spindle assembly induced by Xenopus sperm in M-phase egg extracts [43]. This suggested that AurA kinase activity stimulated by TPX2 might not be essential for spindle assembly.

To further study whether AurA kinase activation by the RanGTP-TPX2 pathway is essential for spindle assembly, a TPX2 mutant was created to manipulate AurA kinase activity. Since the first 43 amino acids of human TPX2 are essential for binding and activating AurA [45], the equivalent N-terminal amino acids (amino acid 1 to 40) of Xenapus TPX2 to create ΔNTPX2 were deleted. Both wild-type TPX2 and ΔNTPX2 were expressed as GST fusion proteins in bacteria. After purification, the GST tag was removed from the recombinant proteins by protease cleavage. TPX2 was immunodepleted from M-phase extracts and found that addition of RanGTP to mock-depleted, but not TPX2-depleted, M-phase extract led to AurA activation, as determined by autophosphorylation of the activation loop at threonine 295 of AurA with antibody recognizing phospho-T295 (FIG. 11A) (Tsai (2003) Nat.

Cell. Biol. 5, 242-248). RanGTP-induced AurA activation in TPX2-depleted egg extracts could be rescued by adding purified wild-type TPX2. When ΔNTPX2 was added to the TPX2-depleted egg extracts, AurA activation was either completely lacking or slightly enhanced compared to the TPX2-depleted egg extract (FIG. 11A). Together, the above studies indicate that the N-terminal region of TPX2 is important for AurA activation by RanGTP.

To determine whether ΔNTPX2 could replace endogenous TPX2 to support spindle assembly stimulated by RanGTP, TPX2-depleted M-phase extracts were supplemented either with purified wild-type TPX2 or purified ΔNTPX2. Although addition of either protein rescued MT aster assembly induced by RanGTP, only TPX2 was able to significantly rescue spindle assembly (FIGS. 11B and C). AurA was concentrated at the centers of MT asters and spindle poles in mock-depleted extracts and in TPX2-depleted extracts with TPX2 add-back (FIG. 11B). However, although ΔNTPX2 was able to support MT aster assembly, AurA was not concentrated at the center of these asters (FIG. 11B). The lack of AurA localization to MT astral centers may explain why ΔNTPX2 was inefficient in rescuing spindle assembly in M-phase egg extracts that were depleted of TPX2 (FIG. 11C). Addition of ΔNTPX2 into TPX2-depleted egg extracts was found to always led to the assembly of significantly more MT asters, which could be due to the lack of spindle assembly in the egg extracts. The findings show that TPX2 binding and activation of AurA are required for spindle assembly stimulated by RanGTP. Since all of the reactions were carried out in the absence of centrosomes, these findings, without being bound by theory, further show that the activation of AurA kinase by TPX2 is required for spindle assembly in the absence of centrosomes.

To test if immunodepletion of TPX2 might be more complete than previously reported [43], *Xenopus* sperm was used to induce spindle assembly in egg extracts depleted of TPX2. The depletion of TPX2 was found to completely block spindle assembly. Only a few half spindles with either focused or unfocused poles were present in the egg extracts. Addition of purified TPX2 fully rescued spindle assembly to the control level, suggesting that the egg extract was not damaged by the manipulation. However, addition of ΔNTPX2 failed to cause significant rescue. Moreover, when TPX2 was gradually replaced by ΔNTPX2 in the add-back experiments, a gradual reduction of good bipolar spindle structures and a gradual increase of bad spindles and half spindles with either focused or unfocused poles were observed (FIG. 12). Therefore, without being bound by theory, AurA kinase activation by TPX2 is essential for spindle assembly either in the presence or absence of chromatin and centrosomes in *Xenopus* egg extracts.

Example 8

AurA-coated Magnetic Beads Function as MTOCs

Having established the important role of AurA activation in spindle assembly in *Xenopus* egg extracts, efficient functional assays to study how this kinase might regulate spindle assembly were developed. While attempting to immunodeplete AurA from M-phase egg extracts using the AurA antibody coupled to protein A magnetic beads, it was found that after stimulating the partially depleted egg extracts with RanGTP, the remaining AurA-beads localized to MT astral centers and spindle poles (FIG. 13A).

To further explore the above observation, magnetic beads were coated with AurA antibody, and then incubated the beads with either purified AurA or the kinase-dead AurA-AA. After incubation, the beads were washed with XB buffer [32] and then added to M-phase egg extracts in the presence or absence of RanGTP. The beads that were coated with AurA, but not AurA-AA, nucleated and organized MT asters and spindle poles only in the presence of RanGTP (FIG. 13B). Although spindles and asters were assembled in reaction containing AurA-AA-beads and RanGTP, the beads were not associated with MT structures. In the absence of RanGTP, neither type of beads induced MT assembly. This suggests, without being bound by theory, that in the presence of RanGTP, the AurA-coated beads may nucleate and organize MTs, and that the kinase activity of AurA is essential for this function.

Next, the ability of AurA-coated beads to nucleate MTs directly from pure tubulin solutions was studied. Beads were first coated with AurA or XMAP215 antibodies, XMAP215 coated on magnetic beads is known to nucleate MTs both in pure tubulin solutions and in *Xenopus* egg extracts [46]. AurA antibody-coated beads and XMAP215 antibody-coated beads were first incubated with M-phase egg extracts at 4° C. to make AurA-coated beads and XMAP215-coated beads, respectively. The retrieved beads were washed with XB buffer at 4° C. Quantitative Western blotting showed that similar numbers of AurA or XMAP215 molecules were coated on the beads. The beads were used to nucleate microtubules by incubating with increasing concentrations of purified tubulin. While XMAP215-beads began to nucleate MTs at 10 μM tubulin, AurA-beads did not nucleate MTs even at 20 gM tubulin (FIG. 13C). Thus, unlike XMAP215, AurA itself cannot nucleate MTs. Therefore, without being bound by theory, AurA-beads must be activated by RanGTP to recruit additional factors in the egg extracts to nucleate and organize MTs.

To test whether RanGTP could stimulate the recruitment of proteins necessary for MT nucleation and organization to AurA-beads, AurA-beads were incubated with M-phase extracts in the presence or absence of RanGTP and/or nocodazole (FIG. 13D). As expected, AurA-beads stimulated the assembly of many MT asters and spindles only in the presence of RanGTP (FIG. 13D). No MT structures were assembled in the absence of RanGTP or in the presence of RanGTP and nocodazole. Only the AurA-beads that were incubated without RanGTP or with both RanGTP and nocodazole were retrieved and washed. MT nucleation assays showed that only the AurA-beads that were incubated with RanGTP and nocodazole could nucleate MT asters (FIG. 13D). Therefore, without being bound by theory, RanGTP stimulates the stable recruitment of MT nucleating activities to AurA-beads.

Example 9

AurA-coated Magnetic Beads Stimulate Microtubule Nucleation & Spindle Assembly by Functioning as Microtubule Organizing Centers (MTOC)

The effect of AurA-beads on MT asters and spindle assembly was studied. Beads coated with AurA, XMAP215, control IgG, or AurA-AA were added to M-phase extracts in the presence of RanGTP. Both AurA-beads and XMAP215-beads, but not AurA-AA-beads or IgG-beads, stimulated the assembly of MT asters (FIGS. 14A and B). Moreover, AurA-beads stimulated spindle assembly in about a third of the time that it took for spindle assembly to occur in extracts containing XMAP215-beads, AurA-AA-beads, or control IgG-beads. Examples of MT asters or spindles formed after 10 minutes of incubation in the presence of beads coated with AurA, XMAP215, control IgG, or AurA-AA are shown (FIG. 14A). At this time point, only AurA-beads induced spindle assembly (FIGS. 14A and B).

While AurA-beads were always localized to astral centers and spindle poles, XMAP215-beads were found at astral centers and along the spindles (FIGS. 14C, D, and E). In contrast, neither AurA-AA-beads nor control IgG-beads were associated with MT asters or spindles (FIGS. 14C, D, and E). To quantify the localization of beads on MT asters and spindles, the distribution of the beads along the spindles was first determined by dividing the spindles into three areas as shown (FIG. 14D). Over 90% of AurA-beads were found at the spindle pole regions, while XMAP215-beads were distributed along the spindle in all three areas (FIG. 14D). Since AurA-AA-beads or control IgG-beads showed little association with MT structures, in a sample of over 100 beads, no (control IgG-beads) or only a few (AurA-AA-beads) of these beads were associated with the spindles in one of the three regions.

Based on quantification of the percentage of asters having one or no beads at the astral centers, it was evident that while nearly 100% of asters had single AurA-beads or XMAP215-beads, few asters were associated with AurA-AA-beads or control IgG-beads (FIG. 14E).

Finally, the percentage of spindles having two beads, one at each spindle pole, or only one bead at one of the two poles was quantified. Nearly 90% of spindles assembled in the presence of AurA-beads had two beads with one at each of their poles, while most spindles assembled in the presence of XMAP215-beads had no beads at the spindle poles (FIG. 14E). As expected, neither AurA-AA-beads nor control IgG-beads showed significant association with spindle poles (FIG. 14E).

The above analyses showed that although AurA-beads and XMAP215-beads were both able to stimulate the assembly of MT asters, only AurA-beads accelerated spindle assembly in the presence of RanGTP (also see FIG. 7). Furthermore, while XMAP215-beads bound along spindles, individual AurA-beads were localized to each spindle pole. These findings suggest that AurA-beads nucleate and organize MTs in a different manner than that of XMAP215-beads in the presence of RanGTP. Since AurA-beads cannot nucleate MTs in the absence of RanGTP in the egg extracts, without being bound by theory, the beads must rely on the recruitment of MT nucleators and motor proteins in the extracts to function as MTOCs.

Example 10

MTOC Function of AurA-beads Depends on MT Nucleators and MT-based Motors

To further understand the MTOC function of AurA-beads, the contribution of MT nucleators TPX2 [47] and gamma-TuRC [41] to MT nucleation by the AurA-coated beads in the egg extract was investigated. Either TPX2 or gamma-tubulin were immunodepleted from M-phase egg extracts, and then used RanGTP to induce MT nucleation from AurA-beads or XMAP215-beads. Depletion of either TPX2 or gamma-tubulin significantly reduced MT nucleation by both AurA-beads and XMAP215-beads. Quantification revealed that when either nucleator was depleted, a higher proportion of AurA-beads failed to nucleate MTs as compared to XMAP215-beads (FIGS. 15A, B, and C). Therefore, MT aster assembly mediated by AurA-beads relies more heavily on MT nucleators than the assembly mediated by XMAP215-beads.

Since AurA-beads stimulated spindle assembly, the roles of two motors, the kinesin Eg5 and dynein, in MT nucleation and organization by AurA-beads was also examined. Inhibiting either Eg5 by Monastrol [48], or dynein by 70.1 antibody [25], completely disrupted spindle assembly in the egg extract containing either AurA-beads or XMAP215-beads. However, inhibition of dynein or Eg5 had a very different effect on the organization of MT asters formed by AurA-beads and XMAP215-beads. When dynein was inhibited over 90% of AurA-beads and XMAP215-beads could nucleate MT asters, and the MTs nucleated from XMAP215-beads were longer than those of AurA-beads. However, when Eg5 was inhibited, while most XMAP215-beads (>90%) were able to nucleate MT asters, only ~40% of AurA-beads could nucleate MTs asters (FIG. 15D). Furthermore, the AurA-beads that did nucleate MT asters were found within hollow centers of the asters that had few MTs. These results indicate that both Eg5 and dynein are required for AurA-bead-based MT organization and spindle assembly. Furthermore, the two motors have different effects on MT organization mediated by AurA-beads and XMAP215-beads.

Example 11

Lamin Expression Constructs, Proteins, and Antibodies

The expression construct for EGFP-tagged human lamin B1 has been previously described [49]. 6His-tagged LB3 was made by cloning the full-length LB3 into the NcoI and HindIII sites of pET30a vector. 6His-taggd ΔNLB3 and LB3T were described [40, 50]. 6His-tagged or maltose-binding-protein-tagged LB3T-nls was made by mutagenizing RGKKRKLDE (the NLS of LB3) to RGASSKLDE resulting in LB3T-nls that does not bind to importin alpha. LB3T and LB3T-nls were expressed in bacteria at 25° C. for four hours, while LB3 and ΔNLB3 were expressed at 16° C. for 12 hours. The proteins were purified using Ni-agarose in with a Tris buffer (50 mM Tris-HCl pH 8.0, 25% Sucrose, 1% TritonX-100, 1 mM PMSF, and 5 mM imidazole). The purified proteins were exchanged into XB buffer (10 mM Hepes, pH 7.7, 50 mM sucrose, 100 mM KCl, 0.1 mM $CaCl_2$ and 5 mM EGTA) using a desalting column and concentrated to 1 mg/ml. Purification of RanL43E, RanQ69L, RanT24N, and importin alpha and beta were described previously [27]. All proteins were snap frozen in liquid nitrogen as small aliquots and stored at −80° C. Monoclonal antibody to *Xenopus* LB3 (L65D5), polyclonal antibodies to LB3, *Xenopus* importin alpha, and *Xenopus* NuMA were obtained from multiple sources. Rabbit antibodies against Eg5 were raised with the C-terminus of *Xenopus* Eg5 (amino acids: 811 to 1091) and affinity purified against the antigen. Antibodies to the following proteins were purchased: human lamin B 1 (Santa Cruz), human lamin B2 (Abcam), PAR (Tulip), gamma-tubulin (Sigma), and importin beta (Transduction Laboratories).

Example 12

RNAi Experiments in HeLa Cells

Regular (Dharmacon) or Stealth (Invitrogen) siRNAs corresponding to lamin B1 [aagcugcagaucgagcugggc (SEQ ID NO: 1) from Dhannacon and uucccaucaacaucaauuucuucga (SEQ ID NO: 2) from Invitrogen] and lamin B2 [aagaggag-gaggaagccgagu (SEQ ID NO: 3) from Dhannacon and gag-gucaacaagagcgccaagaaga (SEQ ID NO: 4) from Invitrogen] were used to down-regulate the respective lamin B in HeLa cells. SiRNAs corresponding to luciferase (aacguacgcg-gaauacuucga from Dharmacon) or Stealth negative control siRNA from Invitrogen were used for controls. 170 μM of Dharmacon siRNA or 4 μM of Invitrogen Stealth siRNA were used to transfect HeLa cells with Lipofectamine (Invitrogen). Cells were analyzed 48 or 72 hours after transfection to determine the level of lamin B reduction by Western blotting. For live cell imaging, HeLa cells were treated with siRNA for 48 hours followed by imaging on a temperature controlled stage at three minute intervals for 12 to 16 hours using a Hoffman modulation contrast objective lens on a Nikon TE200 microscope equipped with an Orca-2 camera. The appearance of a bar of chromosomes at the middle of the cell shows the beginning of chromosome alignment in prometaphase. Metaphase to anaphase transition is clearly detected as the chromosomal bar splits into two. The time elapsed was quantified from the appearance of the chromosomal bar to the splitting of the bar into two. At least 50 mitotic cells were analyzed in either control or lamin B RNAi-treatment. All lamin B siRNAs gave similar phenotypes.

Example 13

Assays for Spindle Assembly in Egg Extract

CSF-arrested *Xenopus* egg extracts, *Xenopus* sperm, and AurA-beads were prepared as described [32]. For spindle assembly induced by sperm, the egg extracts were used directly after crush-spin without further clarification spin. For spindle assembly induced by AurA-beads and RanGTP, the egg extracts were clarified at 12.5 krpm after crush-spin. Spindle assembly reactions were incubated at room temperature for 60 to 90 minutes with sperm or for 10 to 30 minutes with AurA-beads and RanGTP. To immunodeplete LB3, monoclonal antibody or polyclonal antibody to LB3 was coupled to protein A magnetic or agarose beads. IgG from non-immunized rabbits (Jackson Laboratory) was used for mock-depletion. To inhibit LB3 assembly with dominant negative LB3 mutants, LB3T and LB3T-nls were added at 10 μM final concentration, ΔNLB3 and wild-type LB3 were added at 2 μM final concentration to the egg extracts and incubated for 20 minutes before spindle assembly assays.

Example 14

Detection of Lamin B

To detect lamin B 1 and B2 in HeLa cells, the cells were fixed with methanol at room temperature for 20 minutes followed by immunostaining with antibodies against lamin B1, lamin B2, and tubulin. To detect EGFP-tagged lamin B1, HeLa cells were transfected with EGFP-lamin B1 expression vector using Lipofectamine 2000 (Invitrogen) in the absence of serum for 8 to 12 hours, followed by incubating in fresh medium containing serum for 24 hours. The cells were fixed in methanol as described above and immunostained with tubulin antibody. To detect LB3 on spindles assembled in egg extracts, spindles were spun onto coverslips through a cushion consists of BRB80 buffer (80 mM Pipes pH 6.8, 1 mM EGTA, 1 mM MgCl2) and 40% glycerol and fixed with cold methanol (−20° C.) for five minutes before immunostaining.

Example 15

Detection, Assay, and Isolation of LB3-Membrane-Matrix in Egg Extracts

Two methods were used to assay for LB3-matrix assembled in egg extracts. In the first method, spindle assembly was induced with either sperm or AurA-beads plus RanGTP. After incubation, 10 μl of egg extract was diluted into 1 ml XB buffer containing nocodazole (10 μM final concentration) and incubated at room temperature for 10 to 15 minutes to depolymerize MTs. In the second method, egg extracts were incubated with either sperm or AurA-beads plus RanGTP in the presence of 10 μM nocodazole at room temperature for the same time as for spindle assembly reactions. After incubated the egg extracts were diluted into 1 ml BRB80 buffer containing 30% glycerol. LB3-matrix assembled in both methods was spun onto coverslips through 3 ml BRB80 buffer containing 40% glycerol in the same manner as MT spin-down. The LB3-matrix were fixed with methanol (−20° C.) and stained with either polyclonal or monoclonal antibodies to LB3.

To detect the membrane in the lamin B matrix, spindles and LB3-matrices were assembled and spun onto coverslips as described above. The coverslips were incubated in BRB80 containing 20% sucrose and 1 μM Vybrant CM-Dil (Molecular Probes, V22888) for 5 minutes at room temperature and then washed briefly in BRB80 containing 20% sucrose. The structures were then fixed with methanol as above and then stained for LB3 (Alexa Fluor 488 goat anti-rabbit secondary antibody) and tubulin (Alexa Fluor 350 goat anti-mouse as secondary antibody). To determine that membrane is essential for the assembly of lamin B matrix, the spindles were assembled first and then diluted (100-fold) in XB containing nocodazole with or without 0.1% Triton X100 for 10 min at room temperature. The structures were spun onto coverslips and then stained with CM-Dil followed by immunostaining with LB3 and tubulin antibodies. Inclusion of 0.1% triton X100 in the buffer completely disrupted the lamin B matrix. Thus, membrane is an important component of the lamin B matrix To isolate LB3-matrix, AurA-beads and RanGTP were added to 1 ml egg extracts followed by incubation at room temperature for 10 minutes. The egg extract was diluted into 25 ml BRB80 containing 30% glycerol. Spindles associated with AurA-beads were retrieved using magnet and then washed with 25 ml BRB80 containing 30% glycerol for three times. MTs were then depolymerized by incubating the spindles with 25 ml XB buffer containing 10 μM nocodazole. The remaining LB3-matrix was washed with 25 ml XB buffer containing 10 μM nocodazole two times, followed by washing with 25 ml XB for two more times to remove nocodazole. To release the matrix from AurA-beads, the beads were resuspended in 60 μl XB buffer and repeatedly pipetted. The released matrix was separated from the beads using magnet.

To assay microtubule assembly from the isolated matrix, 1 μl of the matrix was incubated with 10 or 20 μM tubulin in 39 μl of XB buffer at 30° C. for 20 minutes. The polymerized MTs were fixed with 1% glutaraldehyde and spun onto coverslips through a glycerol cushion followed by immunostaining.

Example 16

Requirement of Lamin B for Spindle Assembly in Human Cells and in *Xenopus* Egg Extracts To determine whether lamin B plays a role in spindle assembly, either lamin B1 or lamin B2 were reduced in HeLa cells using siRNAs. Quantification revealed that reduction of either isoforms caused an increase of spindle defects as compared to control RNAi-treated cells. Consistent with the spindle defects, live imaging revealed that lamin B RNAi-treated cells spent a significantly longer time in prometaphase and metaphase as compared to controls (FIGS. 8A, B, C, and D). Thus, spindle assembly and function appears to require an appropriate level of both lamin B1 and lamin B2.

Since lamin B has an important function in the interphase nucleus, the spindle defects observed above could be an indirect effect of perturbing interphase nuclear functions. To determine whether lamin B has a direct role in spindle assembly, *Xenopus* LB3 was immunodepleted from M-phase egg extracts using either polyclonal or monoclonal antibodies. Depleting LB3 resulted in severe disruption of spindle assembly stimulated by sperm or AurA-beads plus RanGTP. Addition of bacterial expressed and purified LB3 rescued the spindle assembly in the depleted egg extracts (FIGS. 8E, F, and G). Therefore, lamin B was shown to have a mitosis-specific function in spindle assembly.

Example 17

Assembly of Lamin B-containing Mitotic Spindle Matrix Induced by RanGTP

Purified lamin B neither bound to MTs assembled from pure tubulin nor promoted MT assembly in vitro (data not shown). As an intermediate filament protein, lamin B might associate with spindles as a polymer, which in turn might interact with SAFs to promote spindle assembly. To test this, spindles in egg extracts were made with either sperm or AurA-beads plus RanGTP. As a control, the egg extracts were incubated with AurA-beads plus dimethylsulfoxide (DMSO). DMSO can stimulate assembly of MT asters but not spindles [24]. After incubation at room temperature, MTs were depolymerized with nocodazole. As expected, whereas spindle assembly occurred in extracts containing either sperm or AurA-beads and RanGTP, only MT asters were present in extracts containing AurA-beads plus DMSO, and the asters were not associated with AurA-beads (FIG. 1). After MT depolymerization induced by nocodazole, a matrix-like network of LB3 surrounded over 90% of sperm chromatin or AurA-beads in reactions containing either sperm or AurA-beads plus RanGTP, respectively (FIG. 1). However, in the reaction containing AurA-beads and DMSO, few LB3-matrices were found and they did not show association with the AurA-beads (FIG. 1).

To study whether MT polymerization is necessary for the formation of LB3-containing matrix, matrix assembly in the presence or absence of MT polymerization were examined. AurA-beads and RanGTP or AurA-beads alone were incubated in egg extracts in the presence or absence of nocodazole. After incubation, MTs assembled in the reaction that lacked nocodazole were depolymerized with nocodazole. LB3-matrices were found to be assembled around AurA-beads in the presence of RanGTP whether MTs were allowed to polymerize or not (FIG. 1). However, if MTs were allowed to polymerize, a higher percentage of AurA-beads were associated with LB3-matrix than that of the reaction lacking MT polymerization. Moreover, whereas the LB3-matrix assembled with MTs completely surrounded the AurA-beads, the LB3-matrix assembled in the absence of MTs often only partially surrounded the beads. In the absence of RanGTP, little LB3-matrix was formed (FIG. 1). Therefore, RanGTP, but not MTs, is required for the assembly of LB3-matrix around the AurA-beads.

To examine the requirement of RanGTP and MTs for the assembly of LB3-matrices around sperm chromatin, either RanGTP production on the sperm chromatin with RanT24N (a dominant negative mutant Ran) or MT assembly was inhibited with nocadozole. Over 90% of sperm were associated with LB3-matrix in reaction containing sperm alone by 5 minutes of incubation (FIG. 1). Moreover, although assembly of MTs and LB3-matrix were apparent even with a short incubation time, the two structures did not always associate with one another and often LB3-matrix appeared to lead MT assembly (FIG. 1). When MT assembly was inhibited by nocodazole, LB3-matrix was still assembled around more than half of the sperm, but their sizes were smaller than those assembled in the presence of MTs (FIG. 1). RanT24N dramatically inhibited the assembly of LB3-matrix around the sperm (FIG. 1).

To examine whether the LB3-matrices observed above were initially associated with MTs, AurA beads were used to stimulate spindle assembly in the presence of RanGTP. Nocodazole was used to depolymerize MTs and samples taken at different time points after nocodazole addition were examined by immunostaining. LB3-matrix associated with MTs that were found to be undergoing different degree of depolymerization. The LB3-matrix remained even when all MTs were completely depolymerized (FIG. 1). However, TPX2 a MT-binding protein that is known to exhibit a similar dynamic behavior as tubulin, disappeared as MTs were disassembled in these reactions (FIG. 1). Thus, LB3 matrices were associated with MTs in mitosis.

Example 18

Retention of SAFs by Lamin B-matrix After MT Disassembly

Two SAFs, NuMA and Eg5, have been implicated as part of or being tethered on a static structure corresponding to the putative spindle matrix [51, 52]. In addition, poly(ADP-ribose) (PAR) associates with mitotic spindles and is required for proper spindle assembly [53]. Since PAR detected on the spindle appeared more static than MTs and TPX2, it was hypothesized that PAR could be part of a static scaffold for spindle assembly [53]. To test whether LB3-containing matrix is part of the putative spindle matrix that tethers SAFs, sperm or RanGTP and AurA beads were used to induce spindle assembly followed by nocodazole treatment to reveal LB3-matrix. After MT disassembly, a number of SAFs: PAR, NuMA, Eg5, and XMAP215, remained as part of a matrix in addition to LB3. Both LB3-matrices and SAF-matrices exhibited similar association with AurA-beads with majority of the matrices containing one or two beads. Many matrices, which were associated with two beads, resembled spindles in size and shape. However, little TPX2-containing matrices remained after assembly (FIG. 16A). Thus, LB3 containing-matrix appears to be associated with SAFs.

To test this further, assembly of LB3-matrix with AurA-beads in the presence of nocodazole was induced, followed by double immunostaining using LB3 antibody and antibodies against SAFs. SAFs were found on the same matrices that contained LB3. Examples of Eg5 and XMAP215-containing matrices are shown in FIG. 16C. Comparing to the matrices assembled in the presence of MTs, most of the matrices assembled in the absence of MTs were associated with single AurA-beads (FIG. 16B).

To determine whether LB3 is the structural component of the observed matrices containing SAFs, LB3 was immunodepleted from M-phase extracts and were used sperm or RanGTP and AurA-beads to stimulate matrix assembly. Depleting LB3 inhibited the assembly of matrix structures containing PAR, NuMA, Eg5, and XMAP215. However, depleting either Eg5 or XMAP215 still allowed assembly of LB3-matrices that retained other SAFs (FIG. 16D). Therefore, lamin B is required for the assembly of a spindle-associated matrix that contains a number of SAFs.

Example 19

Disruption of LB3-matrix Assembly by Importin Alpha and Beta

The studies in Examples 11 to 18 suggest that assembly of LB3-containing matrix requires RanGTP, but not MTs. Since LB3 contains a nuclear localization signal (NLS) at its C-terminus that can bind to importin alpha in vitro (FIG. 3A), it was examined whether RanGTP promoted LB3 assembly by displacing importin alpha and beta from LB3. In M-phase extracts, LB3 interacted with importin alpha and beta that could be inhibited by RanGTP (FIG. 3B). To test whether importin alpha and beta could disrupt the assembly of LB3-containing spindle matrix, the spindle assembly was induced with AurA-beads and RanGTP. After spindle assembly, MTs were depolymerized with nocodazole in the presence or absence of importin alpha and beta. Importin alpha and beta severely disrupted assembly of LB3-containing matrices that contained SAFs, and RanGTP could reverse this disruption (FIG. 3C). This suggests that one function of RanGTP in stimulating LB3-matrix in mitosis is to displace importin alpha and beta from LB3.

Example 20

Stimulation of MT Assembly by the Isolated LB3-Matrix

The studies in Examples 11-19 suggest the LB3-containing-matrix might promote MT assembly and organization during spindle assembly by tethering to SAFs. To test the function of LB3-matrix further, the matrix was isolated biochemically. Since centrifugation could pellet both spindles and other dense particulates in M-phase extracts that are not part of the spindle, a strategy was devised to isolate the matrix based on the observation that AurA-beads remained associated with spindles and matrices. Spindle assembly was induced in M-phase extracts by AurA-beads and RanGTP. The assembled MT structures were spun through a glycerol cushion or were retrieved using a magnet. Immunostaining or Coomassie blue staining showed that whereas similar amount of MT structures or tubulin, respectively, were isolated by each method, the magnet method isolated less other proteins than the spin-down method, suggesting that spindles retrieved by the magnet had less contaminants than that of spin-down. The magnet-retrieved structures were treated with nocodazole to depolymerize MTs and the remaining matrices were washed with buffer. The matrices were released from the AurA-beads by repeat pipetting and then the released matrices and AurA- beads were analyzed separately (FIG. 17A). The released matrices contained LB3, Eg5, NuMA, XMAP215, and PAR, but lacked TPX2 and tubulin (FIGS. 17B, C, and D).

The isolated matrix was incubated with pure tubulin to test their ability to nucleate and organize MTs in vitro. The matrix nucleated MT arrays that remained tethered to the matrix (FIGS. 17E and F). No MTs were assembled in the absence of the matrix. To test whether XMAP215 tethered on the isolated matrix could be responsible for MT nucleation, XMAP215 was immunodepleted in the egg extracts and then isolated the matrix in the same manner. These matrices contained little XMAP215 as expected and they failed to mediate MT assembly (FIGS. 17E and F). This suggests that the LB3-matrix could promote spindle assembly by tethering to SAFs to stimulate MT assembly and organization.

Example 21

The Spindle Matrix Components, FAM and p97-Ufd1-Npl4, Regulate Chromosome Alignment and Segregation by Modulating Survivin Ubiquitination Proper chromosome segregation requires the attachment of sister kinetochores to microtubules from opposite spindle poles to form bi-oriented chromosomes on the metaphase spindle. The chromosome passenger complex containing Survivin and the kinase Aurora B regulate this process from the centromeres. Two spindle matrix components, a de-ubiquitinating enzyme, hFAM, and the ubiquitin selective chaperone p97-Ufd1-Npl4 regulate chromosome alignment and segregation by controlling the dynamic association of Survivin with centromeres and the proper targeting of Survivin and Aurora B to centromeres. Survivin is ubiquitinated in mitosis through both K48 and K63 ubiquitin linkages. K63 de-ubiquitination mediated by hFAM is required for dissociation of Survivin from centromeres, whereas K63 ubiquitination mediated by the ubiquitin binding protein Ufd1 is required for association of Survivin with centromeres. Thus, the spindle matrix-associated ubiquinaton activity regulates dynamic protein-protein interactions and chromosome segregation independently of protein degradation [54].

Example 22

The p97-Ufd1-Npl4 Chaperone Regulates Spindle Disassembly as Cells Re-enter Interphase Spindle disassembly at the end of mitosis is a complex and poorly understood process. It was shown that the AAA-ATPase p97 and its adapters Ufd1-Npl4, which have a well-established role in membrane functions, also regulate spindle disassembly by modulating microtubule dynamics and bundling at the end of mitosis. In the absence of p97-Ufd1-Npl4 function, microtubules in *Xenopus* egg extracts remain as mono-polar spindles attached to condensed chromosomes after Cdc2 kinase activity has returned to the interphase level. Consequently, interphase microtubule arrays and nuclei are not established. Genetic analyses of Cdc48, the yeast homolog of p97, reveal that Cdc48 is also required for disassembly of mitotic spindles after execution of the mitotic exit pathway. Furthermore, Cdc48/p97-Ufd1-Npl4 directly binds to spindle assembly factors and regulates their interaction with microtubules at the end of mitosis. Therefore, Cdc48/p97-Ufd1-Npl4 is an essential chaperone that regulates transformation of the microtubule structure as cells re-enter interphase [55, 56].

REFERENCES

1. Pypaert, M., et al., *Mitotic cytosol inhibits invagination of coated pits in broken mitotic cells.* J Cell Biol, 1991. 114: p. 1159-1166.
2. Kano, F., et al., *Cdc2 kinase-dependent disassembly of endoplasmic reticulum (ER) exit sites inhibit ER-to Golgi vesicular transport during mitosis.* Mol Biol Cell, 2004. 15: p. 4289-4298.
3. Schweitzer, J. K., et al., *Endocytosis resumes during late mitosis and is required for cytokinesis.* J Biol Chem, 2005. 16: p. 41628-41635.
4. Bharadwaj, R. and H. Yu, *The spindle checkpoint, aneuploidy, and cancer.* Oncogene, 2004. 23: p. 2016-2027.
5. Hetzer, M. W., T. C. Walther, and I. W. Mattaj, *Pushing the envelope: structure, function, and dynamics of the nuclear periphery.* Ann Rev Cell Dev Biol, 2005. 21: p. 347-380.
6. Altan-Bonnet, N., R. Sougrat, and J. Lippincott-Schwartz, *Molecular basis for Golgi maintenance and biogenesis.* Curr Opin Cell Biol, 2004. 16: p. 364-372.
7. Voeltz, G. K., M. M. Rolls, and T. A. Rapoport, *Structural organization of the endoplasmic reticulum.* EMBO Rep, 2002. 3: p. 944-950.
8. Scott, S. V., et al., *Staying in aerobic shape: how the structural integrity of mitochondria and mitochondrial DNA is maintained.* Curr Opin Cell Biol, 2003. 15: p. 482-488.
9. Pearson, B. J. and C. O. Doe, *Specification of temporal identity in the developing nervous system.* Ann Rev Cell Dev Biol, 2004. 20: p. 619-647.
10. Emery, G. and J. A. Knoblich, *Endosome dynamics during development.* Curr Opin Cell Biol, 2006. 18: p. 407-415.
11. Betschinger, J. and J. A. Knoblich, *Dare to be different: asymmetric cell division in Drosophila, C. elelgans and vertebrates.* Curr Biol, 2004. 14: p. R674-685.
12. Rowinsky, E. K. and E. Calvo, *Novel agents that target tubulin and related elements.* Semin Oncol, 2006. 33: p. 421-435.
13. Hirai, H., N. Kawanishi, and Y. Iwasawa, *Recent advances in the development of selective molecular inhibitors for cyclin-dependent kinases.* Curr Top Med Chem, 2005. 5: p. 167-179.
14. Strebhardt, K. and A. Ullrich, *Targeting polo-like kinase I for cancer therapy.* Nat Rev Cancer, 2006. 6: p. 321-330.
15. Mortlock, A. A., et al., *Progress in the development of selective inhibitors of aurora kinases.* Curr Top Med Chem, 2005. 5: p. 807-821.
16. Weaver, B. A. A. and D. W. Cleveland, *Decoding the links between mitosis, cancer, and chemotherapy: The mitotic checkpoint, adaptation, and cell death.* Cancer Cell, 2005. 8: p. 7-12.
17. Compton, D., *Spindle assembly in animal cells.* Ann Rev Biochem, 2000. 69: p. 95-114.
18. Scholey, J. M., I. Brust-Mascher, and A. Mogilner, *Cell divison.* Nature, 2003. 422: p. 746-752.
19. Pickett-Heaps, J. D., *The evolution of the mitotic apparatus: an attempt at comparative ultrastructural cytology in dividing plant cells.* Cytobios, 1969. 3: p. 257-280.
20. Pickett-Heaps, J. D., *Mitotic mechanisms an alternative view.* Trends Biochem Sci, 1986. 11: p. 504-509.
21. Pickett-Heaps, J. D., D. H. Tippit, and K. R. Porter, *Rethinking mitosis.* Cell, 1982. 29: p. 729-744.
22. Carazo-Salas, R. E., et al., *Generation of GTP-bound Ran by RCC1 is required for chromatin-induced mitotic spindle formation.* Nature, 1999. 400(6740): p. 178-81.
23. Carazo-Salas, R. E., et al., *RanGTP coordinates the regulation of microtubule nucleation and dynamics during mitotic spindle assembly.* Nat Cell Biol, 2001. 3: p. 228-234.
24. Wilde, A., et al., *Ran stimulates spindle assembly by changing microtubule dynamics and the balance of motor activities.* Nat Cell Biol, 2001. 3: p. 221-227.
25. Wilde, A. and Y. Zheng, *Stimulation of microtubule aster formation and spindle assembly by the small GTPase Ran.* Science, 1999. 284(5418): p. 1359-1362.
26. Nachury, V. M., et al., *Importin β is a mitotic target of the small GTPase Ran in spindle assembly.* Cell, 2001. 104: p. 95-106.
27. Wiese, C., et al., *Role of importin-β in coupling Ran to downstream targets in microtubule assembly.* Science, 2001. 291: p. 653-656.
28. Gruss, O. J., et al., *Ran induces spindle assembly by reversing the inhibitory effect of importin α on TPX2 activity.* Cell, 2001. 104: p. 83-92.
29. Zheng, Y., *G protein control of microtubule assembly.* Ann Rev Cell Dev Biol, 2004. 20: p. 867-894.
30. Tsai, M.-Y., et al., *A Ran signalling pathway mediated by the mitotic kinase Aurora A in spindle assembly.* Nat Cell Biol, 2003. 5: p. 242-248.
31. Ducat, D. C. and Y. Zheng, *Aurora kinases in spindle assembly and chromosome segregation.* Exp Cell Res, 2004. 301: p. 60-67.
32. Tsai, M.-Y. and Y. Zheng, *Aurora A kinase-coated beads function as microtubule organizing centers and enhance RanGTP-induced spindle assembly.* Curr Biol, 2005. i15: p. 2156-2163.
33. Tsai, M.-Y., et al., *A mitotic lamin B matrix induced by RanGTP required for spindle assembly.* Science, 2006. 311 (Published online Mar. 16, 2006; 10.1 126/science.1122771): p. 1887-1893.
34. Sillje, H. H. and E. Nigg, *Purification of mitotic spindles from cultured human cells.* Methods, 2006. 38: p. 25-28.
35. Mattout, A., et al., *Nuclear lamins, diseases and aging.* Curr Opin Cell Biol, 2006. 18: p. 335-341.
36. Kehlenback, R. H., et al., *Stimulation of nuclear export and inhibition of nuclear import by a Ran mutant deficient in binding to Ran-binding protein 1.* J. Biol. Chem., 2001. 276: p. 14524-14531.
37. Li, H. Y. and Y. Zheng, *Phosphorylation of RCC1 in mitosis is essential for producing a high RanGTP concentration on chromosomes and for spindle assembly in mammalian cells.* Genes & Development, 2004. 18: p. 512-527.
38. Li, H., D. Wirtz, and Y. Zheng, *A mechanism of coupling RCC1 mobility to RanGTP production on the chromatin in vivo.* J Cell Biol, 2003. 160: p. 635-644.
39. Goldman, D. G., et al., *Nuclear lamins: building blocks of nuclear architecture.* Genes & Development, 2002. 16: p. 533-547.
40. Moir, R. D., et al., *Disruption of nuclear lamin organization blocks the elongation phase of DNA replication.* J Cell Biol, 2000. 149: p. 1179-1192.
41. Zheng, Y., et al., *Nucleation of microtubule assembly by a gamma-tubulin-containing ring complex.* Nature, 1995. 378(6557): p. 578-583.
42. Karsenti, E. and 1. Vernos, *The mitotic spindle: a self-made machine.* Science, 2001. 294: p. 543-547.
43. Brunet, S., et al., *Characterization of the TPX2 domains involved in microtubule nucleation and spindle assembly in Xenopus egg extracts.* Mol Biol Cell, 2004. 15: p. 5318-5328.

44. Tsai, M. Y., et al., *A Ran signaling pathway mediated by the mitotic kinase Aurora A in spindle assembly*. Nat Cell Biol, 2003. 5: p. 242-248.
45. Bayliss, R., et al., *Structural basis of Aurora A activation by TPX2 at the mitotic spindle*. Mol Cell, 2003. 12: p. 851-862.
46. Popov, A. V., F. Severin, and E. Karsenti, *XMAP215 regulates microtubule-nucleating activity of centrosomes*. Curr Biol, 2002. 12: p. 1326-1330.
47. Schatz, C. A., et al., *Importin α-regulated nucleation of microtubules by TPX2*. EMBO J, 2003. 22: p. 2060-2070.
48. Mayer, T. U., et al., *Small molecule inhibitor of mitotic spindle bipolarity identified in a phenotype-based screen*. Science, 1999. 286: p. 971-974.
49. Beaudouin, J., et al., *Nuclear envelope breakdown proceeds by microtubule-induced tearing of the lamina* Cell, 2002. 108: p. 83-96.
50. Lopez-Soler, R. I., et al., *A role for nuclear lamins in nuclear envelope assembly*. J Cell Biol, 2001. 154: p. 61-70.
51. Kapoor, T. M. and T. J. Mitchison, *Eg5 is static in bipolar spindles relative to tubulin: evidence for a static spindle matrix*. J Cell Biol, 2001. 154: p. 1125-1133.
52. Kisurina-Evgenieva, O., et al., *Multiple mechanisms regulate NuMA dynamics at spindle poles*. J Cell Sci, 2004. 117: p. 6391-6400.
53. Chang, P., M. K. Jacobson, and T. J. Mitchison, *Poly (ADP-ribose) is required for spindle assembly and structure*. Nature, 2004. 432: p. 645-649.
54. Vong, Q. P., et al., *Chromosome alignment and segregation regulated by ubiquitination of Surivin*. Science, 2005. 310: p. 1499-1504.
55. Cao, K., et al., *The AAA-ATPase Cdc48/p97 regulates spindle disassembly at the end of mitosis*. Cell, 2003. 115: p. 355-367.
56. Cao, K. and Y. Zheng, *The Cdc48/p97-Ufd1-Npl4 complex: its potential role in coordinating cellular morphogenesis during M-G1 transition*. Cell Cycle, 2004. 3: p. 422-424.

Although the present invention has been described in detail with reference to examples above, it is understood that various modifications can be made without departing from the spirit of the invention. Accordingly, the invention is limited only by the following claims. All cited patents, applications and publications referred to in this application are herein incorporated by reference in their entirety.

SEQUENCE LISTING (684 sequences)

SEQ ID NO: 1 - protein, 3169 aa, Homo sapiens [sequence omitted]

SEQ ID NO: 2 - protein, 2475 aa, Xenopus tropicalis
MRWGALTGLLLALCLCAVVRSAPSSKKRRQAQQQQVVQPHGSPDSQQKGCYDNGKYYQINQQWERTYLGNTLVCTCYGGGRGFNCESKPESEETCFDKYTGVTYRVGETYERPKDNMIWDCTCIGAGRGRISCTIANRCHEGGQSYKIGDTWRRPHETGGYMLECVCLGNGKGEWTCKPVAERCYDNTAGISYVVGQTWEKPYQGWMMVDCTCLGEGSGRITCSSKNRCNDQDTRTSYRIGNSWSKTDTRGNLLQCICTGNGRGEWKCDRHSSAQATGTGSNPITNIQTTLFQPDSELEPYGHCVTDNGVLYSLGMRWLKAQGSKQMLCTCLGNGVSCEETVETITFGGNANGEPCAIPFTHDGKTYYSCTGEGRQDGKLWCATTSNYDTDKKYSFCNEQRALVQTRGGNSNGALCNFPFLYNNRNYTDCTSEGRRDSMKWCGTTANYDADQKFGFCPMAAHEEICTTNEGVMYRVGDQWDKQHDQGHMMRCTCVGNGRGEWTCVAYSQLKDQCIVDGITYDVNSSFTKRHEEGHMMNCTCYGQGRGRWKCDAIDQCQDTETRQFYQIGDSWEKHLQGVRYQCYCYGKGIGEWHCQPLSTSPAGTGPVQVIITESSNFPNSHPIQWNAPQPSHIKNYILRWKPKLKTGPWKQATIPGHLNSYTISGLKPGILYEGQLISILQYGNREVTTFDFTTTSTIHRSSQTETGETTPLPPLVATSESVTEITASSFLVSWVSASDTVSGFRVEYELSEDGDEKRYLELPNTATSVSIPDLLPGRRYNVNVYQITEEGEKSLILSTTQTTAPDAPPDHNVENVDDTSILIKWTKPQAPVTGYRVVYSPSVEGSSTELNLPSTATSVSLTELLPGIEYNITIYAVEDSLESVPIFIQQGTTGTPQTVIVPSPTDLQLVEVTDIKITIMWNPPQSEVSGYRVVVKPVSPSDRDVQNLPVSRNTFAEVVNLHPGRTYTFEVYAVNRGQESEPLAGDFTTKLDAPSDLQFTDVTDSTVVIIWRPPQAKIGRYLLSVGQTRGGQPSQFHINPSATNHKLESLSPGTEYTISLVALKGNQQSASTTGVFSTLEPVGSIPPYNTEVTETTIVVTWTPVPRIGFKLDVRPSQGGEAPREVISESGSIVISGLTPGVEYMYSISVLKDGVERDIPITKTVVTPVAPPTNLRLQPSRDSATLTVYWDSSISPGITGYRITTAPTPMQVGNSLEEEVGPTQTYCLFENLSPGVEYNVSVYAVKGEEESSPLSQIFLQEIPQLTDLKYDDVTDTSIDLRWTPLNSSTIIGYRITVVAAGESVPIYEEFVGPTDGYYKVSGLEPGIDYEISVITLISGGESAPTTIVQHTAVPPPTNLRFTNVGPDTMRVTWSPPTSIELSSFLVRYSPVKKPDDVTELSLSPSTNMVVLSNLLPFTEYLVSVHSVYEERESSALNGVAKTYLDSPTGIDFSEITPNSFTVHWIAPRAPITGYRIRYQLESGAGRPKEERVPPSRNSITLTHLIPGSEYIVSIIAFNGQQESLPLSGQQATVSDVPTDLEVTSSSPNTLTISWEAPSVNVRYYRITHSQTGGHGPEKEFTVPGTSNTATIRGLNPGVSYTITVYAVTGRGDSPASSKPLTIVHMTDVDQPTDMAVTDIQDHSIHVKWSPPPGPVTGYRVTSVPKSGQGETFSQVVSPDQTEVTIVGLQPAVEYVVSIYSQGENGESEPLVETAVTNIDHPKGLTFTDVGVDSIRLAWEVPDGQVTRYRVTYSSPEEGVKELFPAPEGDDDTAELHGLRPGTEYTVSIVALHDDMESKPMIGIQSTAIPAPTNLQFSQVTPSGFSLSWHAPTIHLSGYLVRVNPKEKTGPMKEVRLSPGVTATTVTGLMVATKYEVNVYALKDTLTSQPLQGLISTLDNVSPPRRPRVQDVTETTVTLSWRTKTETITGFQIDAIPAGGQNPIRRTVDADLRSFTITGLQPGTDYKIYLYTLNDNARSSPVIVDVTTAVDSPSNLRFLTTTSNSLLFTWQPPRARITGYIIRYEKAGGLLKEHLPRLQAGTTESTITNLEPGTEYIVYIIAVRNNQKSEPLVGRKRTDELPRLVTLPHPGKGPEILDVPTDEENTPHITQIKLDNGNGIQLPGSNGQQPSSGNEGQLIEEHGFRSPLAPTTAVPVRPGKFTPGHYPQERVDIELDTEFPVQRGDLDGPYPHGLGPQLNDSGVQEVASHTTISWRPELETTEYIISCHPIEHDEAPLQFRVPGTSSSATLNGLTQGATYNIIVEAQKGSDKHKVFEKRVTVGSPGSPEGVLQPAEDTCYDTFNGAHYSVGQEWERMSESGFRLWCKCLGYGSGHFRCDSSKWCHDNGVNHRVGEKWDRRGENGQMMSCTCLGNGKGEFKCEPHEATCYDEGKMYNVGEQWQKEYLGAICSCTCYGGQQGWRCDNCRRPGAVLPDGTAGHTVSQFAQRYQQNYNLNCPIECYLPLQADIQHSEQTQK

SEQ ID NO: 3 - protein, 5202 aa, Homo sapiens
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDKPGPVVPPILLDVKSRMMLVTWQHPRKSNGVITHYNIYLHGRLYLRTPGNVTNCTVMHLHPYTAYKFQVEACTSKGCSLSPESQTVWTLPGAPEGIPSPELFSDTPTSVIISWQPPTHPNGLVENFTIERRVKGKEEVTTLVTLPRSHSMRFIDKTSALSPWTKYEYRVLMSTLHGGTNSSAWVEVTTRPSRPAGVQPPVVTVLEPDAVQVTWKPPLIQNGDILSYEIHMPDPHITLTNVTSAVLSQKVTHLIPFTNYSVTIVACSGGNGYLGGCTESLPTYVTTHPTVPQNVGPLSVIPLSESYVVISWQPPSKPNGPNLRYELLRRKIQQPLASNPPEDLNRWHNIYSGTQWLYEDKGLSRFTTYEYMLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVRVIWTSPSNPNGVVTEYSIYVNNKLYKTGMNVPGSFILRDLSPFTIYDIQVEVCTIYACVKSNGTQITTVEDTPSDIPTPTIRGITSRSLQIDWVSPRKPNGIILGYDLLWKTWYPCAKTQKLVQDQSDELCKAVRCQKPESICGHICYSSEAKVCCNGVLYNPKPGHRCCEEKYIPFVLNSTGVCCGGRIQEAQPNHQCCSGYYARILPGEVCCPDEQHNRVSVGIGDSCCGRMPYSTSGNQICCAGRLHDGHGQKCCGRQIVSNDLECCGGEEGVVYNRLPGMFCCGQDYVNMSDTICCSASSGESKAHIKKNDPVPVKCCETELIPKSQKCCNGVGYNPLKYVCSDKISTGMMMKETKECRILCPASMEATEHCGRCDFNFTSHICTVIRGSHNSTGKASIEEMCSSAEETIHTGSVNTYSYTDVNLKPYMTYEYRISAWNSYGRGLSKAVRARTKEDVPQGVSPPTWTKIDNLEDTIVLNWRKPIQSNGPIIYYILLRNGIERFRGTSLSFSDKEGIQPFQEYSYQLKACTVAGCATSSKVVAATTQGVPESILPPSITALSAVALHLSWSVPEKSNGVIKEYQIRQVGKGLIHTDTTDRRQHTVTGLQPYTNYSFTLTACTSAGCTSSEPFLGQTLQAAPEGVWVTPRHIIINSTTVELYWSLPEKPNGLVSQYQLSRNGNLLFLGGSEEQNFTDKNLEPNSRYTYKLEVKTGGGSSASDDYIVQTPMSTPEEIYPPYNITVIGPYSIFVAWIPPGILIPEIPVEYNVLLNDGSVTPLAFSVGHHQSTLLENLTPFTQYEIRIQACQNGSCGVSSRMFVKTPEAAPMDLNSPVLKALGSACIEIKWMPPEKPNGIIINYFIYRRPAGIEEESVLFVWSEGALEFMDEGDTLRPFTLYEYRVRACNSKGSVESLWSLTQTLEAPPQDFPAPWAQATSAHSVLLNWTKPESPNGIISHYRVVYQERPDDPTFNSPTVHAFTVKGTSHQAHLYGLEPFTTYRIGVVAANHAGEILSPWTLIQTLESSPSGLRNFIVEQKENGRALLLQWSEPMRTNGVIKTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFIRELFERETKIIHINTTHNSFGMQSYIVNQLKPFHRYEIRIQACTTLGCASSDWTFIQTPEIAPLMQPPPHLEVQMAPGGFQPTVSLLWTGPLQPNGKVLYYELYRRQIATQPRKSNPVLIYNGSSTSFIDSELLPFTEYEYQVWAVNSAGKAPSSWTWCRTGPAPPEGLRAPTFHVISSTQAVVNISAPGKPNGIVSLYRLFSSSAHGAETVLSEGMATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHMGLADTKIPRSGTPVSIRSNRSACVLRIPSQNQTSLTYSQGSLHRSVSQLMDIQDKKVLMDNSLWEAIMGHNSGLYVDEEDLMNAIKDFSSVTKERTTFTDTHL

SEQ ID NO: 4 - protein, 600 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQGDPRTTSRGCYVM

SEQ ID NO: 5 - protein, 902 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 6 - protein, 724 aa, Canis familiaris
MTLKLTGSALFCASTFGSLVLWRGFSKPSHHMGRLRNARIHVERAVKQKKIFMIQGRYPVIRCLLRRRGWVEKKMVHHSGTTLPPPQKDLDSSVMGDSDTTEDEDEDEDEAFQLPQLFDFDDLLEFDDLDGTHALMSRMVRNEIPYFIWTTRRDVLDCRFLSKDQMINHYARAGSFTTKVGLCLNLRNLPWFDEADADSFFPRCYRLGAEDDKKAFIEDFWLTAARSVLKLVVKSEWKSYSIQSEEEEVPGDKQPRKQEKKPVTVSPEFVDEALCACEEHLSSLAHVDIDKDLGAPLCLSPEGWSLFLQRYYQVIHEGAELRHLDTQVQRCEDILEQLRAVVPQMDMEGDRNIWIVKPGAKSRGRGIMCMDHLEEMLKLVDGNPMVMKDGKWVVQKYIERPLLIFGTKFDLRQWFLVTDWNPLTVWFYRDSYIRFSTQPFSLKNLDNSVHLCNNSIQKHLENSCHRHPLLPSDNMWSSQKFQAHLQEMGAPDAWSTVIVPGMKAAVIHALQTSQDTVQCRKASFELYGADFVFGEDFQPWLIEINASPTMAPSTAVTARLCAGVQADTLRVVIDRRLDRNCDTGAFELIYKQPAVEVPQYVGIRLLVEGSTIKKPLAMCHQRMGVHPALPHLLTQRGSGEGKDSRPFTHSLHTKARLPSPHVLRSQGGVLRLQHSKLVGSKALSTTGKALMTLPTAKVLISFPSNPELKLASSVLKPRKVGLEL

SEQ ID NO: 7 - protein, 369 aa, Gallus gallus
MAWPCITRACCIARFWNQLDKADIAVPLVFTKYSEATEQPLPAQIPRSAAAPIDTQPGGDARAAGGGDAAPGPARPGTAPHGSPPADSVMRHDYKPWKVQRPEPSCKPKSEYQPSDTPFEKETQYQKDFRAWPIPKRGDHPWIPKAGPSPVLGPERGSPEKAAQEKRRKKEEEAEADEEHPKAARPGDAREKGRQRGDEAGGQEGRGRAAADALNRQIKEEVVAAGVSSSYRNEFRPWIDVKPVKAIKAKAQYKPPEEKMTHETSYSAQFKGETSKPAPADNKFLERRRIRTLYSEPYKEPPKVEKPSVKPSKPKKTTTSHKPLKKAKDKQIASGRAAKKKSAETSNTAKPEDKEKSKEMNNKLAEAKE

SEQ ID NO: 8 - protein, 1902 aa, Xenopus laevis
MATRRAIVPEQQQEPSSPASEISKNKDWQEQSEMVSPTEEEGFCWPGPKSVALRRASEGFGFTLRHFIVYPPESAVHTSVKDEENGNRGVNAGRPRNRLEPMDTIFVKQVKEGGPAHEAGLCTGDRIIKVNGESVIGKTYSQVIALIQNSDSTLELSVMPKDEDILQLAYSQDAYLKGNDSYSGNAQNIPEPPPLCYPRVQPEASVMAQPVEVLPSGTSLATQQSSCPLRTATTQPERSYRVEIQVPPSPTDIVKSNTAVCVCNEAVRTVIVPSEKVVDLSSNRTNRAGPLHRTGLADPSILKRTTSPSSSTPNVPMVPSTRHFDSAGVIGKPPSYGGLAENMFSTRPAAHAEESPSPTNHYASPGSHQHIDWRDYKTYKEYIDNRRMLMYGCRTIQERLDSLRAASQNTTDYNQMLPNRSSGQVRRRSTSHDRVPQSAQMRKRSVSQERLEDPVLMKEWPRSASQDTLTSPAVASRNHRSELWDYLTRKGDFDQFIVETHSNGERNTNYQWSGFTEQDDRRGINERPRQHAFHMSLRSPNFTMAPVPFTSSDNRRGGARVLASAHPLQMVHPDMKTIQPTRNFQNSSRAPHPRPALSDRSGFAISKSNSVKIPTPYAAKPHSPSVRSDDGIVRDQKPVNYLHVGGPQNCQRKTQTESALGFHLDSIKTSMSASSSSPSTSQKVDVKITQSPEANAGDSNAVLSPVDQVVLRERPSPGQQTSPPIRQQSYIFAVNEQEGASDTTCWLPNDARREVHIKRIEQRKASGSNSPGDSLASIPFIDEPTSPSIDHEIGNIPASAVISISAQPLPTITTVPPSPTSPVPLMRRHFSHDHDSIRPIVLEVNSKTERSKSCDEGLDDYKEDGKLCLKQGSSLKGIKARENVQSSEDSESRKDSSSDVFSDSNKEGFLYFRQLTTEKGKRVSGSIRPWKQMYVVLRGSALYLQKDKKEQTGHSSAQSDEEQLIGINGCLIDISYSETKRKNVFRLTTSDREFLFQAEDRDDMLAWIKAIQENGNLNDEQTDQASRVLISKRIKEYNTMMSSSSNKTEPSPKAQRQTLSIRQQFRAGKPDDDISPPKDKGSWRRIMKKPFEKKPTTGGTFGVRLDDCPPAHNNKYVPLIVDVCCKLVEDRGLETTGIYRVPGNNAAISSMQEELNKGNTDIDIQDDKWRDLNVISSLLKSFFRKLPDPLFTNEKYNDFIEANRKEDPVERLKTLKRLILDLPDHHYETLKYLSAHLKTVADSSEKNKMEPRNLAIVFGPTLVRTSEDNMTHMVTHMPDQYKIVETLIQKHDWFFSEESADEPITTVHEESTVESQPVPNIDHLLPNIGRTGLSPGDVSDSATSDSAKSKGSWGSGKDQYSRELLVSSLFAAASRKRKKQKDKPQPSSSEDELDNVFYQKELSQVEFQKPDKQNVDKDMDLKAKANALSLKDADNVKGTNIIKEDKLEKDIMYSEPTSPCPPKLLEPPIANHGLQAPSNDKNIPQINFQMEESMSDSGTMLSTSSQASVQGSKPKVVSPEFKGSDFLTADVSSITSDYSTTSSTIYMTGLDSILISPEVQSVAESKGEEADDERSELVSEGRPMETDSENDFPIFASSLAFDRRHQSKAEEPSRNVQVNSEGSPSCTEGSITPKMDRRRFSSHKLIECDTLSRKKSVQQKTDSDCSAESKTEETLSDAQEAVKKGRSLSIVDPTGNNEPEEPAWRIKITERLKLRLKASADDMFGIGSQKANAAETRKKKNIRRRHTLGGHRDFAEISVLNAWKINEPSSKEAELSAVDRLKPKCPSQDLSISEWLVRERLRTSTSELSTVEPEEKHISETTGQKESASASPPPSSPSQVSTAVLPAGSDSPSHETAPQPDDQMNGDSFQSKNKNNFSPAVDAHPHKLSGTQVVRSRFYQYL

SEQ ID NO: 9 - protein, 1353 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 10 - protein, 578 aa, Homo sapiens
MRQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 11 - protein, 5234 aa, Homo sapiens
MGNEASLEGEGLPEGLAAAAAAGGGASGAGSPSHTAIPAGMEADLSQLSEEERRQIAAVMSRAQGLPKGSVPPAAAESPSMHRKQELDSSHPPKQSGRPPDPGRPAQPGLSKSRTTDTFRSEQKLPGRSPSTISLKESKSRTDLKEEHKSSMMPGFLSEVNALSAVSSVVNKFNPFDLISDSEASQEETTKKQKVVQKEQGKPEGIIKPPLQQQPPKPIPKQQGPGRDPLQQDGTPKSISSQQPEKIKSQPPGTGKPIQGPTQTPQTDHAKLPLQRDASRPQTKQADIVRGESVKPSLPSPSKPPIQQPTPGKPPAQQPGHEKSQPGPAKPPAQPSGLTKPLAQQPGTVKPPVQPPGTTKPPAQPLGPAKPPAQQTGSEKPSSEQPGPKALAQPPGVGKTPAQQPGPAKPPTQQVGTPKPLAQQPGLQSPAKAPGPTKTPPGSAKPPSQQPGSTKPPPQQPGPAKPSPQQPGSTKPPSQQPGSAKPSAQQPSPAKPSAQQSTKPVSQTGSGKPLQPPTVSPSAKQPPSQGLPKTICPLCNTTELLLHVPEKANFNTCTECQTTVCSLCGFNPNPHLTEVKEWLCLNCQMKRALGGDLAPVPSSPQPKLKTAPVTTTSAVSKSSPQPQQTSPKKDAAPKQDLSKAPEPKKPPPLVKQPTLHGSPSAKAKQPPEADSLSKPAPPKEPSVPSEQDKAPVADDKPKQPKMVKPTTDLVSSSSATTKPDIPSSKVQSQAEEKTTPPLKTDSAKPSQSFPPTGEKVTPFDSKAIPRPASDSKIISHPGPSSESKGQKQVDPVQKKEEPKKAQTKMSPKPDAKPMPKGSPTPPGPRPTAGQTVPTPQQSPKPQEQSRRFSLNLGSITDAPKSQPTTPQETVTGKLFGFGASIFSQASNLISTAGQPGPHSQSGPGAPMKQAPAPSQPPTSQGPPKSTGQAPPAPAKSIPVKKETKAPAAEKLEPKAEQAPTVKRTETEKKPPPIKDSKSLTAEPQKAVLPTKLEKSPKPESTCPLCKTELNIGSKDPPNFNTCTECKNQVCNLCGFNPTPHLTEVKWLCLNCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISAQPPPPPPPPPPPPPPPPPPPPPPLPPPTSPKPTILPKKKLTVASPVTTATPLFDAVTTLETTAVLRSNGLPVTRICTTAPPPVPPKPSSIPSGLVFTHRPEPSKPPIAPKPVIPQLPTTTQKPTDIHPKPTGLSLTSSMTLNLVTSADYKLPSPTSPLSPHSNKSSPRFSKSLTETYVVITLPSEPGTPTDSSASQAITSWPLGSPSKDLVSVEPVFSVVPPVTAVEIPISSEQTFYISGALQTFSATPVTAPSSFQAAPTSVTQFLTTEVSKTEVSATRSTAPSVGLSSISITIPPEPLALDNIHLEKPQYKEDGKLQLVGDVIDLRTVPKVEVKTTDKCIDLSASTMDVKRQITANEVYGKQISAVQPSIINLSVTSSIVTPVSLATETVTFVTCTASTSYTTGTESLVGAEHAMTTPLQLTTSKHAEPPYRIPSDQVFPIAREEAPINLSLGTPAHAVTLAITKPVTVPPVGVTNGWTDSTVSQGITDGEVVDLSTTKSHRTVVTMDESTSSVMTKIIEDDEKPVDLTAGRRAVCCDVVYKLPFGRSCTAQQPATTLPEDRFGYRDDHYQYDRSGPYGYRGIGGMKPSMSDTNLAEAGHFFYKSKNAFDYSEGTDTAVDLTSGRVTTGEVMDYSSKTTGPYPETRQVISGAGISTPQYSTARMTPPPGPQYCVGSVLRSSNGVVYSSVATPTPSTFAITTQPGSIFSTTVRDLSGIHTADAVTSLPAMHHSQPMPRSYFITTGASETDIAVTGIDISASLQTITMESLTAETIDSVPTLTTASEVFPEVVGDESALLIVPEEDKQQQQLDLERELLELEKIKQQRFAEELEWERQEIQRFREQEKIMVQKKLEELQSMKQHLLFQQEEERQAQFMMRQETLAQQQLQLEQIQQLQQQLHQQLEEQKIRQIYQYNYDPSGTASPQTTTEQAILEGQYAALEGSQFWATEDATTTASAVVAIEIPQSQGWYTVQSDGVTQYIAPPGILSTVSEIPLTDVVVKEEKQPKKRSSGAKVRGQYDDMGENMTDDPRSFKKIVDSGVQTDDEDATDRSYVSRRRRTKKSVDTSVQTDDEDQDEWDMPTRSRRKARVGKYGDSMTEADKTKPLSKVSSIAVQTVAEISVQTEPVGTIRTPSIRARVDAKVEIIKHISAPEKTYKGGSLGCQTEADSDTQSPQYLSATSPPKDKKRPTPLEIGYSSHLRADSTVQLAPSPPKSPKVLYSPISPLSPGKALESAFVPYEKPLPDDISPQKVLHPDMAKVPPASPKTAKMMQRSMSDPKPLSPTADESSRAPFQYTEGYTTKGSQTMTSSGAQKKVKRTLPNPPPEEISTGTQSTFSTMGTVSRRRICRTNTMARAKILQDIDRELDLVERESAKLRKKQAELDEEEKEIDAKLRYLEMGINRRKEALLKEREKRERAYLQGVAEDRDYMSDSEVSSTRPTRIESQHGIERPRTAPQTEFSQFIPPQTQTESQLVPPTSPYTQYQYSSPALPTQAPTSYTQQSHFEQQTLYHQQVSPYQTQPTFQAVATMSFTPQVQPTPTPQPSYQLPSQMMVIQQKPRQTTLYLEPKITSNYEVIRNQPLMIAPVSTDNTFAVSHLGSKYNSLDLRIGLEERSSMASSPISSISADSFYADIDHHTPRNYVLIDDIGEITKGTAALSTAFSLHEKDLSKTDRLLRTTETRRSQEVTDFLAPLQSSSRLHSYVKAEEDPMEDPYELKLLKHQIKQEFRRGTESLDHLAGLSHYYHADTSYRHFPKSEKYSISRLTLEKQAAKQLPAAILYQKQSKHKKSLIDPKMSKFSPIQESRDLEPDYSSYMTSSTSSIGGISSRARLLQDDITFGLRKNITDQQKFMGSSLGTGLGTLGNTIRSALQDEADKPYSSGSRSRPSSRPSSVYGLDLSIKRDSSSSSLRLKAQEAEALDVSFSHASSSARTKPTSLPISQSRGRIPIVAQNSEEESPLSPVGQPMGMARAAAGPLPPISADTRDQFGSSHSLPEVQQHMREESRTRGYDRDIAFIMDDFQHAMSDSEAYHLRREETDWFDKPRESRLENGHGLDRKLPERLVHSRPLSQHQEQIIQMNGKTMHYIFPHARIKITRDSKDHTVSGNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKLQINYDLGNLIIHILQARNLVPRDNNGYSDPFVKVYLLPGRGAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPTAHKSGQSNHARKQHRHSIAGVLPIQRTQSDNLPPPANGNQDQSQLALRKVMSDGPVKPEGAKPPNHRPAESSVSTGSSGSSFGSGYSVDSEGSSSTAGETNLFPIPRIGKMGQNGQEPVKQPGVGVGLADTEARGQREPKPGQACFLGARNMKEIQPMPEIYPETDKDGEKYPGSLFLPFSNLCQCLIKTNWKPVDGEAQADLELLPNLQTRRILPPSMYLLQKTKALQTYKRSDIRGSNGPTINATTCFETTSVMGEIKIALKKEMKTDGEQLIVEILQCRNITYKFKSPDHLPDLYVKIYVMNISTQKKVIKKKTRVCRHDREPSFNETFRFSLSPAGHSLQILLFSNGGKFMKKTLIGEACIWLDKVDLRKRIVNWHKLLVSPTQTH

SEQ ID NO: 12 - protein, 1836 aa, Xenopus laevis
MDKEEENKYVSQLLGVFNSCDTTGTGYLDKEELTDLCHKLHLDAQLPLLLQTLLGTDIFARVNFEEFKEGFVAVLSSTIDISISEDESSYLEPVIPDEVKPKYVKGTKRYGRRTQPEREAAENEANKCLQEQHQVKGQRKSQLKRSSSLESVESLKSDEEAENGKEPLNENFEAQGQLRAWNPEIFDGRRRNSSPCSDMTEHQVRDIWEELGVGHNGYLNQQELATVCKNIGLKDLSKEELEDLFNKLDRDGDGRVSFQEFQDGLFSHAPVPISSTPLKNRRPWACFQPVEDSSRMTTTNSLLSAFGGLHLFSTIDDGTGFGSPEQIMIIWEEEGIEDGKEILTSLDFSLGERVNLLDLTTALDNELIATKNRIHMAALASYKNELYHQHGLVEQVTRERDKVKQDFEKAEKRNLQLANEVDDHNSEMEQLNESKIKDLELEYRQRLSVLRTELESEKEQFIHQADQHKTKLESDLANLKIEEAALRERLNLSVKENSRLQKEMVEVVEKLSEAENDVVTLQTNVEDMLKGKRQSDHPHMEFCNQDERFADIINEYEIQCRELRDQNDELQIQLETLRSQLSESKYSRLLARIKDNKLLHLKAKEKIHNNSLSNGSQGKKGMSTKLRRSASAAGANGPVAMEPEPPPVNIEAELTKQQLKEQQQEIQDLKIELETKVNYYEREVELMKSNFEKERKATEHSFKLEISELEEQKADLEELNAKYQEVIDGLKVQLSKSAQCQEMEKRFKEEKFELEQYYAKEISALGQRLTAEKDQLEEELRRTHQHELQSMRQEAEEELNEKLAASEAQWAEHWQNLLQQHYNEKNEALEKYELAKISWREEQLRERNLWEERERTLLAQCRKEQLKQEEKHSEEQAHICKTFAIEKEEIESQYKIQMNRLNREIESLSSCLESRGNDSTMTADRGPSGQYLNLNSDDKDHSNKTEVVHFIKQDELSETTGQLTETPNPQCAQILYCLKDVDEKLSLLKRTEESAEVKLHKMECVVSSLRAQLLDDIKETEALLKKHGYLEEEKAQLSRQLEAMEEERLLSEAKQNQLMVELWEKCDYIKVQDSKLQLISKDNEELEKQVAALTGQAVALEHKLNAFSGKYQEMTARLSEAIDGVSSEQNVCHTQDGDPTNEGILMEELLARNTLLSRQLSNKEEEVYVLQREMNEMVRQFQELEIEAIKYPTDANQENKEERDSVIDKLVELEDLVRQLERETETSQDDRMELCRLTEDNGLLRNKLEGLQKEVHDFEDQANKHRKEVEHLKKEKEKLVCELEELNKQSQKYQEEARLLNAQSLQLSSAILDLTAQNKQNQETTQQLSSSLRDMAQQKEEAAASVTQLQEMMCRLEQANVQQEAESQGQRDQLEKDLQRFKDENQKYQDELHRLNAQTLQLNASVADLSAWKMEKQETLQNLTSQLRDVTQREEAEQAEGTRLHKVLSALEREKDRLEHELDVSKEECQKYREELRQLNTQSLQLSSSVSDLSVQHSGNQEVIQQLNNRLREVTKQKEDAAAVVEQLKDVLNTLEREKLQHLAAWQQERNQLAQELRTSNEKMENHTQKHMREKEGLLSGLHESNKQLVIMDSLQEEVTSLRQEKQSLGEQCHSLTSQLKDVAAQVMKMHKLERDLKVAHEESQTLKRNQAQLRETLAECQDQLLEANSKLTLEQSQHMRQVQQLKEQVSCAVPMEQVTELQNRLREEEQNSLQLQDKMRFHAEQTNRLLAMQQEEHEKLLRRMEERLEEVEMDLKNVRLMLQEKVNQLKEQLEKNAKSGLLLKDLYVENAQLMKALQVTEQRQKSAEKKNYLLEEKISALNKVIGRIAPASLAV

SEQ ID NO: 13 - protein, 704 aa, Mus musculus
MDTSSPFYAAGQGEASPPSLPVSISSPSLQSRMVRNETPYLIWTTRRDVLDCRFLSKDQMINHYARAGSFTTKVGLCLNLRNLPWFDEADADSFFPRCYRLGAEDDKKAFIEDFWLTAARNVLKLVVKLEEKSQSISIQAREEEAPEDTQPKKQEKKLVTVSSDFVDEALSACQEHLSSIAHKDIDKDPNSPLYLSPDDWSQFLQRYYQIVHEGAELRYLEVQVQRCEDILQQLQNVVPQLDMEGDRNIWIVKPGAKSRGRGIMCMNRLDEMLKLVDCNPMLMKDGKWIVQKYIERPLLIFGTKFDLRQWFLVTDWNPLTVWFYRDSYIRFSTQPFSLKNLDNSVHLCNNSIQRHLEASCHRHPMLPPDNMWSSQRFQAHLQEVDAPKAWSSVIVPGMKAAVIHALQTSQDNVQCRKASFELYGADFVFGEDFQPWLIEINASPTMAPSTAVTARLCAGVQADTLRVVIDRRLDRSCDTGAFELIYKQPAVEVPQYVGIRLLVEGSTIKKPVPVGHRRTGVRSSLPHLLTQQGSGESKDSGSPTHRSASRKNARAESLEHTEKPEPAAVASVSGKGKKAPFHFPSLHSKAWLPSPRVHRPQGRVLRLQHDQLVGSKALSTTGKALMTLPTAKVLMSFPPHPDLKLAPSMLKPGKVGFELCCTTWRVVLSGGIGEEGHRQRAAPRPSSAPGKGLSSTEPCSKTET

SEQ ID NO: 14 - protein, 1035 aa, Xenopus tropicalis
MSGKIEKADSQRSHLSSFTMKLKDKFHSPKIKRTPSKKGKPADLTVKTEEKPVNKTLSRLEEQEKEVVNALRYFKTIVDKMAVDKMVLVMLPGSASKVLEAILPLVQVDTRCQESTAISSCYSRVYQSLANLIRWSDQVMLEGVNSEDKEMVTTVKDVIKAVLDGVKELVRLMIEKQEHPSPTTTVKPSLPASKTDSTTELPLSERELEILNKTPEPTSKEAQVDSLESEELAPPKPPLPGIRVMDNSPPPALPPKKRQSAPSPTRVAVVAPMSRATSGSSLPIGINNQDFEGDCYVRRRLSGGSQSYGGESPRLSPCSSIGKLSKSDEQLSSLDRDSGQCSRNTSCETLDNYDPDYEFLQEDLSRTDQVPGHGTILSPLPESLESASPFQGQSFQMPAGDTPNSEHSAVETPPALPQKKRRSTAPQTSDGIRGCYERHPSQYDNLCEDDLSPFVSAAMPPFAAVSPFQQGSPSQAEFLGDFVAAESDGIPENPPPLPEKKNKHMMTYMRFVEDYSEPQPSVFYQTPQNEHIYQQKNKHLREVYGFNDSFSSPESGHERVPPPALPPKQRQMDSPLPNEGPQQNCTLPCLPGKDNHEASERPPKSPDCHSDENGEGEEEEELDELSLVDHNEIMAKLTLKQEGDDGPDVRGGSGDILLVHATETDRKDLVLYFEAFLTTYRTFITPEELIQKLQYRYERFCHFQDTFKQRVSKNTFFVLVRVVDELCLVEMTDEILKLLMELVFRLVCKGELSLARILRKNILEKVENKRMLHHANSALKPLAARGVAARPGTLHDFHSLEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALAEVEPPCIPYLGLILQDLTFVHLGNPDHIDGKVNFSKRWQQFNILDSMRRFQQVHYEIRRNDEIISFFNDFSDHLAEEALWELSLKIKPRNVTRRKTERDEKT

SEQ ID NO: 15 - protein, 207 aa, Gallus gallus
MDEERLSDNVRLYKGGSIRQGLRSFAAVYVLLALSFLLLTLLSSVSLARIAALSSKLSTLQSEPKHNFSSRDSLLFPCGAQSRQWEYFEGRCYYFSLSRMSWHKAKAECEEMHSHLIIIDSYAKQNFVMFRTRNERFWIGLTDENQEGEWQWVDGTDTRSSFTFWKEGEPNNRGFNEDCAHVWTSGQWNDVYCTYECYYVCEKPLPK

SEQ ID NO: 16 - protein, 313 aa, Homo sapiens
MELDRAVGVLGAATLLLSFLGMAWALQAADTCPEVKMVGLEGSDKLTILRGCPGLPGAPGPKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 17 - protein, 238 aa, Cyprinus carpio
LDCTVIDGNLKQIDAGSGSVVGVNNLNETFVLIDNVFTKISGSLKHFSVGPAGQLGVNTANNIFKYQSGGFVQLAGLLKQVDAGGDQIIAGVNMYDDIYCLNMDANNKWPSSNTPWVQINGKLKYYSCGPYSCWGVNSNDQIFIMKDVSSNVCSGSGSFINIPGLLSMIEVATDGSVFGVNSQGNLYQRTGVTRSKPDGTDWISMVACPNGHKHVSFDLGVLWLVCVDGSIRKCILTD

SEQ ID NO: 18 - protein, 320 aa, Xenopus tropicalis
  misc_feature (144)..(144): Xaa can be any naturally occurring amino acid
MLVYVLFLLPLLVPGGLSQSCGESVVIVASKQLAKQLDFSKENQFRSCKEIKDSNNDSQDGLYKLTSSDGISYQTFCDMTTNGGGWTLVASVHENYMAGKCTEGDRWSSQQGNRADRPEGDGNWANFNTFGSPGGATSDDYKNXGYYDIEADNLGVWHVPNKTPLSVWRNSSLQRYHTTDGVLFKNGGNLFSLYQIYPVKYGIGSCQKDSGPIVPVVYDFGSPNLTASFYSPDFRSQFTPGYIQFRPFNNEKAALALCPGMKMESCNAEHVCIGGGGYFPEADPRECGDFAAYDFNGYGTKKLNSAGKEITEAAILLFYL

SEQ ID NO: 19 - protein, 346 aa, Xenopus laevis
MALMKTKFNLKRRVKLAQGLWLMNWCCVLAGIALFSMGVFLKIELRKRSEVMDNDESHFVPNSLILMGSLACALNAFAGKICYDSLDPTKFARWKPMLKPYLIICLIFNIFIFFTGVVCFLTRGSLESTLAHGLKNGMRYYKDTDIPGRCFLKKTIDLLQIEFKCCGNNGFRDWFELQWVSNRYLDFSSKEVKDRIQSNVDGKYLIDGVPFSCCNPSSPRPCIQLQVTNNSAHYSYDHQTEELNLWSKGCKEALLNYYTSMMSSMGGMVFLVWIMEMAVMIGLRFLHTCLETIANPEDPECESEGWILEKSLKDTIKSSWELVKSMGKLNKVETAGGEEAGVATVS

SEQ ID NO: 20 - protein, 3592 aa, Bordetella parapertussis
MNTNLYRLVFSHVRGMPVPVSEHCTVGNTSCGRTRGQARSGARATSLSVAPNALAWALMLACAGLPLGTHAQGLVPQGQTQVLQGGNKVPVVNIANPNSGGVSHNKFQQFNVANPGVVFNNGLTDGVSRIGGALTKNPNLTRQASAILAEVTGTSPSRLAGTLEVYGKGADLIIANPNGISVNGLSTLNASNLTLTTGRPSVNGGRIGLDVQQGTVTIERGGVNATGLGYFDVVARLVKLQGAVSTEQGKPLADIAVVAGANRYDHATRRATPIAAGARGAAAGAYAIDGTAAGAMYGKHITLVSSDSGLGVRQLGSLSSSSAITVSSQGEIALGDATVQRGPLSLKGAGAVSAGKLASGGAVSVAGGGAVTVASASSVGNLAVQGGGKVQATLLNAGGTLQVSGRQAVQLGTASSRQVLSVNAGGALKADQLSATRRLDVDGKQAVTLGSAASRNALSVRAGGALKADQLSATRRLDVDGKQAVTLGSVASDGALLVSAGGNLQAKQLVSNAGLDVRGQREVSLEAASSVRGMTVAAAGTLAARNLQSKGAIRIQGGQAVSVANANSDAELHVSGRGQVDLGDLSAARGADITGEQRVSIGRAHSDGDVNVAARGALSIDSMTALGAIGVQAGDSVSAKDMRSRGAVTVSGGGSVNLGDVQSDGQVRATSAGAMTVRDAAAAADLALQAGGALQAGFLKSAGAMTVNGRDAVRLDGAQAGGQLRVSSDGQAALGSLAAKGALTVSAARAATVAELKSLDSISVTGGERVSVQSVNSASRVAISAHGALEVGKVSAKSGIGIEGWGAVAADSLGSDGAISVSGRDAVRVDHARSLADISLGAEGGATLGAVEAAGSIDVRGGSTVAANSLRANRDVRVSGKDAVRVTAATSGGGLHVSSGRQLDLGAVQARGALALDGGAGVALQSAKAGGTLHVQGGEHLDLGTLAAVGAVDVNGTGDVRVAKLVSDAGADLQAGRSMTLGTVDTTGDLQARAQQALELGSVKTEGGLQAAAGGALSLAAAEVAGALELSGHGVTVDRASASRARIDSTGSVGIGALKAGAVEAASPRRARRALRQDFFTPGSLVVRAQGNVTVGRGDPHQGVLAQGDIVMDAKGGTLLLRNDVLTENGTVTISADSAVLEHSTIESKISQSALAAKGDKGKPAVSVKVAKKLFLNGTLRAVNDNEETIPGRQIDVVDGRPQITDAVTGEERKDESVVSDAALVADGGPIVVEAGELVSHAGGIGNGRNKGNGASVTVRTTGNLVNKGYISAGKQGVLEVGGALTNEFLVGSDGTQRIEAQRIENRGTFQSQAPSGTAGALVVKAAEAIVHDGVMATEGEMQIAGKGGGSPAVTAGAKATTSANKLSVDVASWDNAGRLDIKKGGAQVTVAGRYAEHGKVSIQGDYTVSADAIALAAQITQRGGAANLTSRHDTRFSNNIRLMGPLQVNAGGAVSNTDSLKVREGVSVTAASFDNEAGAEVMAKSAALTTSGAVRNAGKMQVKEAATIVAASVSNPGTFTAGKDLTVTSRGGFDNDGKMESNKDIVIKAEQFGNAGVLDAKHDLTVTASGQADNRGSLKAGHDFTVQAQRIDNSGTMAAGHDATLKAPHLRNTGQIVAGHDIHIINSAKLENTGRVDARNDIALDVADFTNTGSLYAEHDATLRLAQGTQRDLVVDQDHILPVAEGTLRVKAKSLATEIETGNPGSLIAEVQENIDNKQAIVVGKDLTLSSAHGNVANEANALLWAAGDLTVKAQNITNERAALIEAGGNARLTAAVALLNKLGRIRAGEDMHLDAPRIENTAKLSGEVQRKGVQDVGGGEYGRWSGIGYVNYWLRAGNGRKKAGTIAAPWYGGDLTAEQSLIEVGKDLYLNAGARKDEHRHLLNEGVIQAGGHGHIGGDVDNRSVVRTVSAMEYFKTPLPVSLTALDNRAGLSPATWNFNSTYELLDYLLDQNRHEYIWGVYPTYTEWSVNTLKNLNLGYQAKPAPTAPPMPKMPTLDLRGHTLESAEGRKIFAEYKKQQGEYEKAKAAVQAVEAYGEATRRVHDQLGQRYGKALGGMDAETKEVDGIIQAFAADLRTVYAKQAGQASIDAETDKVAQRYKSQIDAVRLEAIQPGRVMLAKALSAALGADWRALGHAELMQRWKDFKAGKRGANIAFYPKEQTVLAAGAGLTLSNGAVHNGENAAQNRGRPENLKIGAHSATSVGGSFDALRDVGLEKRLDIDDAVAAVLVNPHIFTRIGGAAQGALADAAAGPALARQVRQAPGTDGMVDTRGLGSADALASLASLDAAQGLEVSGRRNAQVADARLAGPSAVAASAVGAADVGVEPVAGDQVDQPVVAVGLEQPAAAVRVAPPAVALPRPLFETRIKFIDQSKFYGSRYFFEQIGYQPDRAARVAGDNYFDTTLVREQVRRALGGYESRLPVRGVALVAKLMDSAGTVGKALGLKVGVAPTAQQLKQADRDFVWYVDTVIDGQKVLAPRLYLTEATRQGITDQYAGGGALIASGGDVNVDTNGHDVSSLNGLIQGKRVKVDAGKGRVLVADSKGMGSGIEADEEVDVSGRDIDIEGGKLRGKDVRLKADTVKVATSMRYDGKGRLAARGDGALDAQGGQLHIEAKRLETAGATLKGSKVKLDVDDVKLGGVYEAGSSYENKSSTPLGSLFAILSSTTETNQSARANHYGTRIEAGTLEGKMQNLEIEGGSVEAAHTDLSVARDARFKAAADFAHAEHEKDVRQLSLDAKVGAGGYEAGFSLGSESGLEAHAGRGMTAGAEVKVGYQASHEQSSETEKSYRNANLNFGGGSVEAGNVLDIGGADINRNRYGGAAKGKAGAEEALRMRAKKVESTKYVSEQTSQSSGWSVEVAATASARSSVLTAATRLGDSVAQNVEDGREIRGELMAAQAAAEATQLVTADTAAVALSAGISADFDSSHSRSTSQNTQYLGGNLSIEATEGDATLVGAKFGGGDQVSLKAAKNVNLMAAESTFESHSESHNFHASADANLGANAVQGAVGLGLTAGMGTSHQITNETGKTYAGTSVDAANVSIDAGKDLNLSGSRVRGKHVVLDVEGDINATSKQDERNYNSSGGGWDASAGVAIQNRTLIAPVGSAGFNFNTEHDNSRLTNDGAAGVVASDGLTGHVKGDANLTGATIADLSDKGNLKVDGAVNAQNLKDYRDKDGGSGGLNVGISSTTLAPTVGVAFGRVAGEDYQAEQRATIDVGQTKDPSRLQVGGGVKGTLNQDAAKATVVQRNKHWAGGGSEFSVAGKSLKKKNQVRPVETPTPDAVDGPPSRPTTPPASPQPIRATVEVSSPPPVSVATVEVVPRPKVETAQPLPPRPVPAKAVPVAPPKVEVAKVEVVPRPKVETAQPLPPRPVVAEKVTTPAVQPQLAKVETVQPVKPETAKPLPKPLPVAKVTEAPPPVMETAQPLPPVKPQKATPGPVAEVGKATVTTVQVQSAPPKPAPVAKQPAPAPKPKPKPKPKAERPKPGKTTPLSGRHVVQQQVQVLQRQASDINNTKSLPGGKLPKPVTVKLTDENGKPQTYTINRREDLMKLNGKVLSTKTTLGLEQTFRLRVEDIGGKNYRVFYETNK

SEQ ID NO: 21 - protein, 1461 aa, Xenopus laevis
MWSSALAFCLLLTAFPGGDSAPPHPKYMLLVPTVLHGGSEEKFCLLLSQLNETVTVTLTMGLPRQNHTLLEKQVTDKEDDSCVPFQTPKLDDVEVGYLTLLVDGDTLHFTSRRSVLIKPLQNLVFVQTDKPIYKPGQKVQFRIVSLDEKFYPVSEQFPVVYITDPKGNRISQWLNVEIKNGLTQESFQLSSEPGLGTYHVNVKREKGDLVIYSFSVEEYVFPKYEVQVKLPAVVTILDKEVKVTVCGRYTYGKPVLGMINVHVCRKFTERYNPCPDEEDGVCEEINQHAGCGCVSDVVNTKIFQMRRTGYEMKIIASAKITEDGTGVEMTGEGSAEIKSSLAKVSFRQLTQYKRGIPLYGQVFLEDAGGNPMSNETVVVYVGDDGTNFTYITAQDGTADFSIDTSSIQLSSLRIKVSYKTGGYCPRYRWLAASYEEDTRTIKHFYSLSKSYLKIQPIHRTLECQTVEEVHVHYILTPEGVGEARSAVFHYLVMAKGGIAENGKHTLEVLSNQEAHGQFSFNLPVGINISPSAKVLVYLVLDSGEVIADSITLTVQECFGSKVKLSFSPTEALPGSQAHLQLSTSRASLCALRAVDESVLILKPEAELSAHMIYDLLPLKDLSGYDHDGKFLEEPREDPCLSLEPILLNGIYYTPSNPEGDTDTYRILKDLGLKVFTNTNIRIPVVCEERLGRGAVQFSSFAVSADFGMEMAPMALMHSTEVIETVRKYFPETWLWDLVETDADGNADVAVTVPDTITTWKAGMFCTSKDAGFSLSETISLVAFQPFFLDLTLPYSAIRGEKFTLKATLFNYLSQTIRVAISLEDSDQFLAKPTNLQEDGYCARRKWSNHSLTGSVALQSLGEVNITMTAETLTGEGLCENEIVSPTQGRKDTITKHILVEPEGVEREETQNAMICGKGSEINEDIHLKLPEKVVEGSARAYFSVIGDILGTALQNVGNLVQMPYGCGEQNMVLFTPIIYISEYLNKTNQLTPEIRSKTLSYMSTGYQKQLSYKHYDGSYSAFGQQYGEGNTWLTAFTMKSFARARAHIYIEEKLIADALTWLSNHQKENGCFRSVGRLFNNAMKGGVDDEVTLAAYITIALLEYPLPVTHPTVRNSLFCLETALGGQNSIYTKALIAYAFTLAGKMDIRHKLLQSLDEQAIKKDGTVHWQRPETSDDSGLYRDPYSRAPSAEVEMTSYVLLALLSKPDVSDEDLTLATQVVSWIIKQQNPSGGFSSTQDTVVALQALALYGSLTLSHDATRTVLLALDKTPVAKFNVEDSNRLLLQQIALNEVPGDYTATVSGSGCLYLKTTLRYNVPHPKEDAAFTILLTTEPTTCDQKSLKSFAILANVSYIGKRENSNMVLMEIKMPSGYIPVKSSVKKLPQSNNLIERTETQINKVILYFESLSKDIQSFSFLVEQDIPISNLQPATAIIYDYYEKDDFAVTKYNAPCSAKDGGSNE

SEQ ID NO: 22 - protein, 679 aa, Rattus norvegicus
MSLSVMEEGLMSLSVMEEGLRGLSVMEEGLRNLSVMEEGLRGLSVMEEGLRRLSVMEEGLRGLSVMEEGLRSFSVMEEGLRSLSVMEEGLRSLSVMEEGLRSLSVMEEGLRSLSVMEEGLRNLSVMEEGLRGLSVMEEGLMGLFVMEEGLMSLSVMEDGLRSLSVMEEGLMGLSVMEEGLKSLSMMEEGLRGLSVMEEGLMGLSVMEDGLRSLSVMEEGLMGLSVMEEGLRGLSVMEEGLRGLSMMEEGLRGLSVMEEGLRSLSVMEEGLRSLSMMEEGLRSLSVMEEGLRSLSVMEEGLMGLSVMEEGLMSLSLMEDGLRSLSVMEEGLKGLSTMEVGLRGLSVMEEGLRRLSVMEEGLRSLSVMEEGLRNLSVMEEGLRNLSVMEEGLRGLSVMEEGLRSLSVMEEGLRSLSVMEEGLRGLSVMEEGLMGLSVMEEGLRGLSVMEEGLRSLSVMEEGLRSLFMMKEGLRSLSVMEEGLRRLSVMEEGLRSLSVMEEGLRNLSVMEEGLRNLSVMEEGLRGLSVMEEGLRSLSVMEEGLRGLSVMEEGLKSLSMMEEGLRGLSVMEEGLMGLSVMEEGLMGLFVMEEGLMSLSVMEDGLRSLSVMEEGLMGLSVMEEGLMGLFVMEEGLRSLSVMEEGLMGLSVMEEGLMGLFVMEEGLMSLSVMEDGLRSLSAILNI

SEQ ID NO: 23 - protein, 1960 aa, Macaca mulatta
MHPPPSLDGHAARPSGTRTPGRTRAGTGKRPSLAAIADTAFKQKRRPGGWDRDLTRSSQKRKTGRKGRPLGGRLLHSSAVSPWLQGASMGLLQVLAFSFLETAGPGASLEWRSLETTPEPQGLSMGSPTSGKRRPPRDPAPRPQRSAGDPRACTHTHSRAPCSQISTRTLTPRMRGLPRARGFTCVALCGARVRAQEPEFSYGCAEGSCYPATGDLLIGRAQRLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFSEEVEGMVHGHCMCRHNTKGLNCELCMDFYHDLPWRPAEGRNSNACKKCNCNEHSSSCHFDMAVYLATGNVSGGVCDDCQHNTMGRNCEQCKPFYYQHPERDIRDPNFCERCTCDPAGSQNEGICDSYTDFSTGLIAGQCRCKLHVEGEHCDVCKEGFYDLSGEDPFGCKSCACNPLGTIPGGNPCDSETGHCYCKRLVTGQHCDQCLPEHWGLSNDLDGCRPCDCDLGGALNNSCSAESGQCSCRPHMIGRQCNEVEPGYYFATLDHYLYEAEEANLGPGVSIVERQYIQDRIPSWTGAGFVRVPEGAYLEFFIDDIPYSMEYDILIRYEPQLPDHWEKAVITVQRPGKIPPSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGFFGNPSEVGGLCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTAEPNSTVEQSALMRDRVEDVMMERESQFKEKQEEQARLLDELAGKLQSLDLSAAAEMTCGTPPGASCSETECGGPNCRTDEGEKKCGGPGCGGLVTVAHNAWQKAMDLDQDVLSALSEVEQLSKMVSEAKLRADEAKQSAEDILLKTNATKEKMDKSNEDLRNLIKQIRNFLTQDSADLDSIEAVANEVLKMEMPSTPQQLQNLTEDIRERVESLSQVEVILQQSAADIARAEMLLEEAKKASKSATDVKVTADMVKEALEEAEKAQVAAEKAIQQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQKYLEDKAQELARLEGEVRSLLKDISQKVAVYSTCL

SEQ ID NO: 24 - protein, 1822 aa, Canis familiaris
MAKAWQRPFVNVFRHCRVGEWRRCSREGDVAAVTDKSLRCAVYRIRDAPSAGGYIQLPGTSMQSLGLTGHYLYVLFRPLPGKHFIIQLDVATKDGQVVRMSFSNLFKEFKSTATWLQFPLIWGTRVGASDARWTCLQLDLRNILLVYVNRRYGHLKSVKLCASLLVKSLYTSDLCFDPTLTVAEAQRARLRVTPVPREMAFPVPEDESWYDHYVHIRFPSDSSEASPGPVQESRSPPEADFLGRVPRLLPHPGASSSAAQDGAPSAGPIAPCQAPSVPRPLPEVSLFCEPSEVPTGSEPSAPAHARHKHAAGNGDDVSAPKPTVEPAVRGDVAVHKPFGGKQSKQEVALAKHPFQKRSFLPDPILRLKGVVGFGGHSTKWALWTKDGSAVVYPCHAVVVVLRTDTREQRCLLGHTDKVSALALDGDNVLLASAQARPSSMLRLWDFGTGACLSLFRSPAHTLCSLSFSRGGALLCGVGKDRQGRTVVVAWGTAQVGRGGEPVLLAKTHTGVDIQAFEVAFFDETRMASCGQGSVRLWRLRGGQLRSCPVDLGEHRVLELTDLAFGPAHDGHMLYVCGRSGHILEIDHQHMAVRHARRLLPVWTPGSPVSQKQTFGSGPGISISSLSTSQATCAVGSEDGYLRLWPLDFSSVLLEAEHEGPVTWVRVSPDGLRVLSATSLGHLGFLDVPSREYRVLVRSHTAPVLALATECSHGQLATVSQDHTVRVWDLATLQQLHDLRSPEEAPCTVAFHPTRPALFCGFSSGAVRSFSLESAEVLAAHRCHQGPVTGLAASPDGSLLFSSCSSGTLAQYHCAATQCRVLRVAANVVCRDAHPTPNALVLSGDSHLLAFVGPSKYVVTVMNAASLEELLRVDVRALDLASARLASAVALCFGPGPPGHLLVSTSSSTVVVLDSTSGRVVRELPAVHSGACPSLALSRDARFLLTAADRAIKLWDYPTQACPGCQVYIGHSEPVRAVAFAPDQQRLLSVGDAIFLWDILGPLERSAGDSPGAPPTCEASPDARQLEDVVSGAHGLPRQQVPKPSQASPLQLGVCAGLLRDDDGAFSWSDEEGPSEESHIPEGLRQGSSLPVLVKEASGAGDGVWGSPGDPRGLSMHPHPHGWPSAQGTRKAQVCPSARPDCYKHFVARYKTSSLPKSASVSRGSAERLLLKAVMGYNGNGRANVVWKPDTGFFAYTSGCLVVVEDLHSGAQQHWLGHPEEISTLALSHDAQVLASASGCGSTASCCQIRIWNVPGGSCRQLISYHSTAVQALAFSPDDELLVTLGDYGDRTLALWSMATCELLSATCLPEPVHGVAFNPWDAGELACVGQCAVTLWLLRGPNASLQGRREPLPEELGAGELTSLCYGAAPLLYCGSNAGQVCVWDTSASRCFLAWEADDGEIGVLLCSGTRLVSGSNTRRLRLWAVGAVPELRCKDSRARSSSVFMERELTLDGAVVSAVFHDTMDMGVVGTTAGTLWYVSWVEGSSTRLISGHRSKVNEVVFSPSASHWATCSDDGSVRVWSLASMELLIQFQVLNQSCLCLAWSPASCARPEQQQVAAGYSDGTLRVFSISRIAMELKMHPHRAALTAIAYSADGQTILSGDKDGLVAVSRPRTGMTFRVLSDHRGALISTVQSRSKEHGDFGAQWGDLWLAASSDQRISVWAANWPQGHCELVDWLSSPSPTLMEGPSQPPSSLVAFCPWDGSLLVCAGLGVRPEVVFYSLHQKQVVERIPLPFFAVSLSLSPGARLVAVGFAERVLRLVDCESGTMQDFAGHDDLVQLCRFAPSARLLFSAAHSEILVWEVAGPWAAGGASGSGPLLG

SEQ ID NO: 25 - protein, 3110 aa, Homo sapiens [sequence omitted]

SEQ ID NO: 26 - protein, 573 aa, Leucoraja erinacea
MRSAVSLSLFLALIVRVHSDIVLTQPETETATPGGSITLNCKISGFTVGSQWMALVRQVPGQGLEWLLHYHSPGNEQFAPGIKSRFTPSNDKTNNIFIVTASSLKIEDTAVYYCARGTTMIPLDYWGGGTMLTVTNAAPSAPSPFILFTCEDQGSSGSFTYGCLALGYSPAGASVSWKKDDIKLETGVKGYPAVFNKLGTYTRSSELTITEAAAAGGDIFCVVQHNHNEYKVKVQLPDRVVHHPTVTITITALDEIKRQGKAIAVCLVNDFTPAIFTVNWLKNGKPLDSGIVTSPAFQVNGTGNFSATSQLTFTAEEWFGDFVYTCQVNHEKDLKSQNISMPPDVSCDKLSITILPPQVEQELMEMTVTLTCLVSDAPYGITVSWKRGNVPLVSYIQPTGPADIVQSKVNISTQDWLSGDYFECAVSHADMPKPKTERINWKKGQHLLPPSVSVLLPPTEEISAHKTITLTCFVRGFSPRRVFVTWTLDDKRVDESKYKNTEVEAENGNDTFFTYSLLSVGAEEWASGASFSCLVGHEALPMKTIVRTVNKSSGKPSFVNVSLVLMDTVNSCQ

SEQ ID NO: 27 - protein, 447 aa, Ciona intestinalis
MAAAEVLLKTEPAPQSIPVDALGKKEHCIPINTGSYTSHGLATAGFRSSKYTPDEWHQNNYSKFYQSFSDRDNAERIQHESKKLANETLAITNRTQADVTKKLGERIHDINFWKFELQREIDDLIAETELLFQQKVRLEKALDATEIPMQIATDNLECRFRRQGPDLVKDNVEIQLLREVDLLKSVQDLLKRTIEQTKNQIRMNRDAKQNLELDWSDKLDAHNIDDKCGRLNNQSTDIQYHPNSAKFEDNSSTPETWAQFTHDNIVRAERERMASINLRSLIDNVLHDTSDDLREQCNSVNEAFAKRVEEMNDAKTKLENHLQKVLIEIGNQEHNIAMLKDAINDKEAPMQVSQTRLHHRTYRPSVELCRDPVQYRLVSEVGEITDSIEKLKFRLSEAERSLHELEDTRMALEKEIAIKTNSLFIDREKCMTVRTRYPTVIKLSGYQ

SEQ ID NO: 28 - protein, 1874 aa, Homo sapiens
MLGSSVKSVQPEVELSSGGGDEGADEPRGAGRKAAAADGRGMLPKRAKAPGGGGGMAKASAAELKVFKSGSVDSRVPGGPPASNLRKQKSLTNLSFLTDSEKKLQLYEPEWSDDMAKAPKGLGKVGSKGREAPLMSKTLSKSEHSLFQAKGSPAGGAKTPLAPLAPNLGKPSRIPRGPYAEVKPLSKAPEAAVSEDGKSDDELLSSKAKAQKSSGPVPSAKGQEERAFLKVDPELVVTVLGDLEQLLFSQMLDPESQRKRTVQNVLDLRQNLEETMSSLRGSQVTHSSLEMTCYDSDDANPRSVSSLSNRSSPLSWRYGQSSPRLQAGDAPSVGGSCRSEGTPAWYMHGERAHYSHTMPMRSPSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 29 - protein, 1865 aa, Homo sapiens
MHSIRTVEIKVPEIEETFFAPRFSEEPRGGRGGGGGGRGARPELRSAQPLVGAALCTEHVRAPPAPSRSRSRSDGSHGSRRALCKAAADASGASRARVGLPSQRLPPPPPDSPGRLPRPGPGAEEGRDGLSARGAAAQQRDCTMGNQDGKLKRSAGDALHEGGGGAEDALGPRDVEATKKGSGGKKALGKHGKGGGGGGGGGESGKKKSKSDSRASVFSNLRIRKNLSKGKGAGGSREDVLDSQALQTGELDSAHSLLTKTPDLSLSADEAGLSDTECADPFEVTGPGGPGPAEARVGGRPIAEDVETAAGAQDGQRTSSGSDTDIYSFHSATEQEDLLSDIQQAIRLQQQQQQQLQLQLQQQQQQQQLQGAEEPAAPPTAVSPQPGAFLGLDRFLLGPSGGAGEAPGSPDTEQALSALSDLPESLAAEPREPQQPPSPGGLPVSEAPSLPAAQPAAKDSPSSTAFPFPEAGPGEEAAGAPVRGAGDTDEEGEEDAFEDAPRGSPGEEWAPEVGEDAPQRLGEEPEEEAQGPDAPAAASLPGSPAPSQRCFKPYPLITPCYIKTTTRQLSSPNHSPSQSPNQSPRIKRRPEPSLSRGSRTALASVAAPAKKHRADGGLAAGLSRSADWTEELGARTPRVGGSAHLLERGVASDSGGGVSPALAAKASGAPAAADGFQNVFTGRTLLEKLFSQQENGPPEEAEKFCSRIIAMGLLLPFSDCFREPCNQNAQTNAASFDQDQLYTWAAVSQPTHSLDYSEGQFPRRVPSMGPPSKPPDEEHRLEDAETESQSAVSETPQKRSDAVQKEVVDMKSEGQATVIQQLEQTIEDLRTKIAELERQYPALDTEVASGHQGLENGVTASGDVCLEALRLEEKEVRHHRILEAKSIQTSPTEEGGVLTLPPVDGLPGRPPCPPGAESGPQTKFCSEISLIVSPRRISVQLDSHQPTQSISQPPPPPSLLWSAGQGQPGSQPPHSISTEFQTSHEHSVSSAFKNSCNIPSPPPLPCTESSSSMPGLGMVPPPPPPLPGMTVPTLPSTAIPQPPPLQGTEMLPPPPPPLPGAGIPPPPPLPGAGILPLPPLPGAGIPPPPPLPGAAIPPPPPLPGAGIPLPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGVGIPPPPPLPGAGIPPPPPLPGAGIPPPPPLPGAGIPPPPPLPRVGIPPPPPLPGAGIPPPPPLPGAGIPPPPPLPGVGIPPPPPLPGVGIPPPPPLPGAGIPPPPPLPGMGIPPAPAPPLPPPGTGIPPPPLLPVSGPPLLPQVGSSTLPTPQVCGFLPPPLPSGLFGLGMNQDKGSRKQPIEPCRPMKPLYWTRIQLHSKRDSSTSLIWEKIEEPSIDCHEFEELFSKTAVKERKKPISDTISKTKAKQVVKLLSNKRSQAVGILMSSLHLDMKDIQHAVVNLDNSVVDLETLQALYENRAQSDELEKIEKHGRSSKDKENAKSLDKPEQFLYELSLIPNFSERVFCILFQSTFSESICSIRRKLELLQKLCETLKNGPGVMQVLGLVLAFGNYMNGGNKTRGQADGFGLDILPKLKDVKSSDNSRSLLSYIVSYYLRNFDEDAGKEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKAKISMKT

SEQ ID NO: 30 - protein, 1505 aa, Salmo salar
MLGNTYIGLLATAALLSLIQDGTYGSVEGDRSSVTMRDAGTCTVHSDFHYSTFDWANFRFVVPCTYVLAQLCSSSEIPLSHFSVEVKNEQRGNSSVSPVLQVNVEVENLRVSLHKRQNHRVMVNGIWKKLPLSLNGGTINIRGNAASVVLETNFNLFVSYDDSCAVHITVPASYSGKVCGMCGNFNHLRDDDYHTADGSEASTAATFGQSWQSQKACQSTVVPHECPPMEEAEYASEPYCGSLVSRHGPFAECQSVLGAESYFRSCVAGMCGAGGGLEVLCEALQSYADMCLKAGGPVLAWRNSTMCPLECGVNSHYNVCAEGCPEACSIMDAQGACGSCEERCECNPGFKISGGRCVSAEDCGCWMNGVHYEKGATFMDGECDRVCQCMGGGRLQCSASSCADGEVCKVKEGVMGCFPSSPAICRVYGDPHYITFDGKAYTFQGGCSYTLAKTCGGHTPIQFSVTGQNWNPGSESSAKLAAVVLETKGLHLKIDNYSATVNHVWQSLPIAVNGPYGEMKLYKKKQYTVMETTFGLQMLLDDHHRLFLQLDERYKGEMCGLCGTYSDDQGDDFLTPNGTKPETNEVTFANSWRVKSPEDDRCVASPPAPQPCDSHLDNQGFQECSKLLRDTFKPCHPFVHPTPYIDSCMSDHCASGGDMHVTCYSLKSYVTACQVASVTLPPWCNDTACDSLPGPPTKPPVTTPDNKFCPLDCNFDNSECGWEQIVQDSFDWRRQRGPTPSDLTGPTQDHTTGGGSYMYIEGNGVYYGDSARMISPKCQKGATNYCLRFWYHMYGQAKAMILNVYQLDERNKHRKLWSKANNQGSTWYLAKVDINTDGSFQIIMEGIRGSDPQSDVAFDDVSIHYGSCSGSSTGVVGGPSVPPPVEEGSFIPHPVCNFDCTFEEDLCSFTQLMTDSFDWTRHSGSTPTAMTGPSADHTKGDIGHYLYIEASNVSNGDTARLLSSECSDPGLQCLQFWYHMSGSAKTMGLHVYILQDRSADRVWWKRNNQGDCWQLAQVDLRTTGPFQIIFEGRRGTTDQSDVAIDDVSLHRGQCEDLIKPTTPTEKPFPADKSTIAPTPAPITMRPVTLRPTTAAPAPTNSTMTSKPSTTARPQPTTTMRPETPAPPTTEIPSPPRPTTERPQPPRPTTARPQPPNTAKPTPSCPNNSHFTPCISDCQPTCKHLHGPPDCHSDEHCVQGCVCDNGFVLKQRVCVPIQQCGCVDSNGNSHCFKESWYTEHCHQKCECVEDDGVGEIDCDDEYECDGDAICLQNEAGLYFCKSTGFSECSINGDSEYRTFNNTKHDFEGTNSYVLVQNTDLSKNQPDIYIEAINAIVNQDGGDSSQGDSSQGDSSQGDSSDVDSSDEDDKHKDSMRMGNSEDKHDHSDEDSDEDKIENNNRLRLRGLKIRVYNHMVEFRKNRKLVLDGRSTHAPVSPAGGLRILESSSRIYLKTDFGLSVEFDGHSRAVIILPHTYKRRLGGLCGNFDGKKKNYMMKPNGNQANIVK

SEQ ID NO: 31 - protein, 169 aa, Rana temporaria
YEDRNFQGRCYECSGDCADLHSYFSRCNSIKVDSGCWMLYERPNFLGHQYFLKKGEYPDYQQWMGFSDSVRSCKVIPQQKGPHKMKIYEKEELKGQMLEVLEDCPSVFELFKNHDINSCNVLEGHWIFYEQPNYRGRQYFLKPGEYKRFSDWGSLNARVSSFRRVLDSC

SEQ ID NO: 32 - protein, 607 aa, Mus musculus
MAHEVDLESFKELERDIILRVLYRDQTVQSTEEERVRKLKSHLQHLRWKGAKSSSQEYKEKCCARCQRALGLLLNRGAVCQGCSHRVCSECRVFLRRTRAWKCTVCFEDRNVKIKTGEWFFEERARKFPTAGRRETAGAKLLQSYQRLSKISVVPPTPPPFSESQCSSSSRLQELGHFRGFNKSVENLFLSVTTQMRKLSKSQNDMTSEKHLLAMDPRQCVGHTERRSQSDTAVNVTSRKASTPDILKAFHQEDPKHPPDPVLKQDTPPSSPTHSAVFSGGLRHGSLISINSTCTEMGNFDNANVTGEIEFAIHYCVKSCSLEICIKTCKNLAYGEEKKRKCNPYVKTYLLPDRSSQGKRKTRVQKNTLDPTFEETLKYQVDPGQLMTRRLQVSVWHLGTLARRVFLGEVILPLAMWDFKDSTAQNARWYPLRAKAEKYEENIPQNNGELAVRAKLVLPAGPRKPQEAQEGQLALNGQLCLVVLGAKNLPVRSDGTLNSFVKGCLTLPNQQKLRVKSPVLKKQACPQWKHSFVFNGVSSSQLRQSTLELTVWDQAIFGMNDRLLGEARLGSKGGAAGCPDSGSQSKLQWHRVLSSPNLWTDMTLVLH

SEQ ID NO: 33 - protein, 424 aa, Bos taurus
MRARGCGRLALPLLLLSAAALAEGDAKGLKEGETPGNFMEDEQWLSSISQYSGKIKHWNRFRDEVEDDYIKSWEDNQQGDEALDTTKDPCQKVKCSRHKVCIAQGYQRAMCISRKKLEHRIKQPAVKLHGNKDTVCKPCHMAHLASVCGSDGHTYSSVCKLEQQACLSSKQLTVRCEGPCPCPTEQAATSTSDSKPETCTGQDLADLGDRLRDWFQLLHENSKQNGSANSGASPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEETEEEEGEAGEADDGGYIW

SEQ ID NO: 34 - protein, 280 aa, Xenopus laevis
MGWHDGCIRCMVGVPFASVIATVLCFAGVALFCGCGHEALSGTEKLIETYFSKNYQEYEYLIHVINAFQFVIYGIAIFFFLYGILLLAEGFYTTTAIKHILGEFKPPAMKGGLISTVTGGPPKGRSTRGRQPVHTIELICRCLGKWLGHPDKFVGVTYVITILWILIFACSAVPVYIYFNTWVTCQSMAFPGKTTTSVSTLCLDARMYGVLPWNAFPGKVCGTSLLAICKTSEFQMTFHLFIAAFVGAAATLVALLTYMVGASFNYAVLRVTGRSDRSKF

SEQ ID NO: 35 - protein, 1368 aa, Xenopus laevis
MERDIYGDMADQHIPVGQGVQIRFIGDLKENGKPRGKRSKQDSYGVAVRVQGIDGQPFVVLNSGDKAKSSFGVQIKSQEPYLNASNTSPPNYQNYSSKPRGPSRSISSESELPENPYGSRGYRPSSSHYSSASDEEQKPRGNIRGSDGLSSLPRPLQASRREELRRSQSHSSLLEPDVEESYDYDHHYSERSSTLDTTYSQSSRDSAWSRSSQKKIDNGDYPSLGYRSATSQQSTSVSNKTKKNGLSTSSPSNQSNEDIDTKPLSSVDSLINKFDIKGQVRGRTARRSQALKDERKRSQSLDGRKNYHDTADSREIIVEKQNEVQTMREPVNASNRSFNRQTLERGDISKTRLTKEWLDQDREEPVILKQQRTVQSEFQLKSTPDLLRDQQPDGSDPTREMIFGILREGSLESENTLRKKTSILLEKLPSLQVQPGEDTISLGSQKKELERKVAELQRQLDDEMKQRMKLETSQGRPKAGMQRLEIELEESKEECSRLKELYEKKKNELSAMSQELMEVRMGKEQVETKLRTMEDKLMDSKEELSHLRAKGGTSPDKLALLKELEEVQDELDEVLQIRQKQEELLRQKDRELTALKGALKDEVANHDKDLDRVREQYQNDMQQLRKNMDNVSQDQLSLESERQKINQVVRNLQRELEESSDEISQWKEMFQKNKEELRSTKQELLQMKLEKEESEDELKETRDRFSLLQSELAQVKKGSVDPGEVASVRKELQRVQDQLKQLSVDKQKVEENLQQREREMSALKGTLKEEVSGRDRETVRLREQLQSEVMHVKKENEGLAKESRRIQDQLKQVLLEKQRHEETVHQRERELSVLKGALKDEVSGRDRETEKLRERLEQDALMTKRSYEELVKINKRLESEKTDLERVRQVIENNLQESREENDDLRRKILGLEAQLKETNTFCDDLQRAESRLKDKINKLEAERKRMEDSLGEVADQEQELAFVKRDLESKLDEAQRSLKRLSLEYEELQECYQEEMKQKDHLKKTKNELEEQKRLLDKSMDKLTRELDNMSNESRGSLQLLQTQLEEYREKSRKEIGEAQKQAKEKTAEAERHQFNSSRMQEEVQKLKLALQELQVEKETVELDKQMISQRLQSLEQDIESKKRVQDDRSRQVKVLEDKLKRMEAELDEEKNTVELLTDRVNRSRDQMEQQRAELNQERSRGQDLECDKISLERQNKELKNRLASMEGQQKPSVNVSHLEAKLQEIQERLQLEEREKATLLSTNRKLERKLKELNIQLEDERLQVNDQKDQLNLRVKALKRQVDEAEEEIERLEGLRKKAVREMEEQQEINEQLQTRVKVMEKESKRKPIRPAHDDDLSSDGEFGGPYDPSSITSLLTESNLQTSSC

SEQ ID NO: 36 - protein, 5255 aa, Gallus gallus
MGIVATVLLWVVTEAARGRWCERTEQVTEEEVVMPRREDVVPCPSMYQYSLAGWRIDLNRMRQVYGGERGVPPTSTHPGAAMCYIYRPPETQLVVRNRTVRACCAGWSGPHCTEVEGSLGQCHASWQCQDALGAHNLSTVSMAECCRQPWGHSWRNGSSALCFACSRQPLTGDVPLPTAPRGPAARHRGPTASCTVWAGSRYRSFDGRHFGFQGECAYSLAASTDSTWAVSITPGSPPVLHMTFGLDTVVAQGHNISVNGVAVPEGRQHLHGGISVTWLGDFVAVESGLGVHLKLDGRGTVYVTVSAELRGSTKGLCGPYNDDPIDDFLRVEGDVAPLAASFGNSWRIPDANPELSCSDAVEPSPGCAMGSTAQRAAEAMCGMLLTDPFRQCHEAVDPHGFYEACLELHCREGGTGPSPPPAVCDTLATYVRDCAQRRAYIEWRRPGLCEQQCGHGQRYSDCVSSCPASCMAAGTAEEGHCRDDCASGCECTPGLLLDRGACIPQSACPCLHRGHIYAPGQSIRQRCNQCTCRGGRWLCTQDRCAAECAVLGDLHYITFDRRRFSFPGACEYTLVQDFVEGTLRITAEQEACGGHQPLSCLRALSITVPGASARLHSTGEVVVDGRVVPLPFASAALTVRRASSSFLLLQTFGAHLLWGLETPAAYITLQPAFANKVRGLCGTYNWDQRDDFATPAGDVEVGVTAFANKYRVSTDCPVLSPVPFEPCSTYAPRRELAAAACAILHGASFQPCHHLVDREPFHQLCLYDVCACPAGKHCLCPALAAYARECAQEGAALSWRNESFCGTQCRGGQVYQECSSPCGRTCADLRLDGASSCPSLDNICVSGCNCPEGPVLDDGGQCVPPGVCPCQHSSQLYPAGSKIRQGCNACMCTAGTWSCTDAPCPDAAFCPGDLVYVFGSCLRTCDSAEPNGTCTGIADGCVCPPGTVFLDERCVPPEECPCQHNGRLYHPNDTIVRDCNTCVCRQQRWQCSSEDCMGTCVATGDPHYITFDGRAFSFLGDCEYVLVREANGLFTVTAENVPCGTSGVTCTKSVVVEMGNTVVHMLRGRDVTVNGVSVRPPKVYSGNGLTLQRAGIFLLLLSRLGLAVLWDGGTRVYIRLQPQHRGRVVGLCGNFDRDAENDLASQQGVLEPTAELFGNSWRVSLLCPEVDGTTAQHPCTDNPHRATWARKRCSILTQRLFAPCHDEVPCQHFYDWCIFDACGCDSGGDCECLCTAIATYAEECSQRGIHIRWRSQDLCPMQCDGGQEYSACGPPCPQTCRNLGLELPEHCDTMSCLEGCFCPEGKVLHEGSCIDPAECPCFWQGIAFPDSAVVQQGCRNCSCTAGLWQCVPTAEPCPAQPHCPDSEFPCRSGGRCVPGAWLCDNEDDCGDGSDEVCALHCAPHQHRCADGQCVPWGARCDGLSDCGDGSDERGCPPPPCAPPEFRCASGRCIPRAHVCNGELDCGFADDSDEAGCSPSCSVGEFQCAAGRCVPYPHRCNGHDDCGDFSDERGCVCPAGHFQCPDAQCLPPAALCDGMQDCGDGTDEAFCPDRITCAPGQLPCPDGSCVSQVKLCDGIWDCRDGWDESSVRCMVSWAPPAPTQLPTVPANGTAAPVCGPYEFPCRSGQCVPRGWVCDSEADCPDNSDELGCNRSCVLGHFPCALGAHCIHYDHLCDGIPHCPDHSDESDDNCGSTQIPPCPGHFVCNNRVCVNATRVCDGALDCPQGEDELACEGYVPTGERNQTVGPCAEYSCRDGDCITFKQVCNGLPDCRDGDMASGWLPSDEWDCGQWGPWAPWGICSHSCGLGQQLRARECSQRTPGVLHQCHGEATQARPCFSTACPVDGAWSEWTMWSNCTQGCEGVVVRQRHCQPPRDGGRPCAALPATAHATLEIGTCQQDGCPPASCPGGLQPRPCAPCPASCADLASRAPCRREQCTPGCWCAEGLVLDGERGCVRPRECRCEVDGLRYWPGQRMKLNCRLCTCLDGQPRRCRHNPACSVSCSWSAWSPWGECLGPCGVQSIQWSFRSPSHPGKHGTNRQCRGIYRKARRCQTEPCQECEHQGRSRAQGDRWRWGPCHVCQCLPGPEVRCSPYCARSAVGCPQGQVLVEGKGDSCCFCAQIGDNVTAIPTALTMEPPSTMPGEPSDSPLPTFPLPSPGDPCYSPLGIASLPDSSFTASAEQQQHPARAARLHHVSPGLELQGWAPPADTVPGLPSHLPFLQLDLLQTTNLTGVVVQGAGAGDAFITAFQLQFSTDGNRWHNYQQLFQGNWDATTPVVQPLDHMVQARYIRILPQGFHNAIFLRAELLGCPTVPLDLAVTTAVTPAPCGTGEFWCGVSCVTASRRCDGATDCPGGADEAGCEPPSSTTLPTHPASLTTPGSAGILGLTAEPPVAPPAAVPEGTSAWLTVGSTSPAVPSTTGLPGVPTATITPRGPPSAGPPSPGMAAVTVSHPVMGPPALPMPPTGVPTPTSAEPPLPRLLCPPDQFLCDALGCVDAAMVCDGQQDCLDGSDEAHCGALPTSGSSPSPLAWPSSPPPTCSPKQFSCGTGECLALEKRCDLSRDCADGSDESSCADCILSPWGGWSQCSHSCGLGVTSRQRVLLRGALPGGTCHTPRLDTRACFLRACPVPGAWAAWGVWSSCDAECGGGMRSRTRSCTDPPPKNGGQPCAGEALQSQPCNLQPCGDTRECGPGMVLVQEGDCVQGLVPPCPQVCGDLSATSSCQSPCQEGCRCPPGLFLQEGTCVNASQCHCHQGQQRWLPSQVFLRDGCSQCVCRDGVVTCEDTACPIACAWSAWSLWTLCDRSCGVGMQERFRSPSNPAAANGGAPCDGDTREVRECHTPCATAEPSSGWSSWTPWSPCSRSCFHHVDQRGRRHRFRHCEGMGTCPGLGVQEEPCDTAPCPVAGVWMPWSAWSECSAPCDAGVQTRSRTCTPPAFGGAECTGPHLQTRNCNTRPCGAQCPDTMQYLTAEECRHSEGRCPWICQDLGAGVACTAQCQPGCHCPAGLLLQNGTCVPPSHCLCHHRGHLYQPGDINALDTCNNCTCVTGQMVCSTETCPVPCTWSNWTAWSTCSHSCDVGMRRRYRVPIVPPLAGGGPPCQGPSMEVEFCSLQPCRAVAPWGPWSECSVSCGGGYRNRTRDGPPLHSLEFSTCNPAPCPGKEPGVCPPGKQWQACAQGAASCAELSAAPPADGSCHPGCYCPPGALLLNNECVAEAACPCAVDGVLYQPGDVVPQGCHNCSCIAGRVTNCSQEDCGDVDGPWTPWTPWSECSASCGPGRQRRYRFCSAHPGVPCAEPQPQERPCARQPCHSPDCAAVPGSVFSHCRPPCPRSCDDISHCVWHRQPGCYCTNGTLLDATGTACVALENCTCLDAHSGQRHQPGQSVPRGDGCNNCTCTQGRLLCTGLPCPVPGAWCEWSPWTPCSRSCGDEAATRHRVCSCPAPQQGGAGCPGGLEGHGDTGMQLQHQECPSVPPCPEDGAWAAWGPWSGCGGCGGQAVRTRSCSSPPARFGGLPCAGEARQSRACPWATSSCPECAGGLVAFTCGKPCPHSCEDLREDTACMATPRCLPACACPHGQLLQDGDCVPPELCRCAWAPSKNGSIWEQDGAVPMQELQPGETVQRHCQNCTCKSGTLQCHAEPGCRADGGWSPWGPWSPCSPGCQAGTQLASRQCNNPTPQLGGRGCSGHSQRQRPCPATEGCPEEEPWGEWSPWGPCSASCGGGEQLRHRDCPPPGGCPGLALQSKTCNTHVCREAGCPPGRLYRECQQGEGCPYSCAHLAGRIACFPGGCQEGCHCPTGTLLHHGHCLQECPCVLTAEVLRKLRNSSADLQAAPHLLGTRGPPLALDQELPPGSTIHSACTSCTCLHGRLNCSEPVCPRDGGFSPWGPWSSCSRSCGGLGVMTRRRGCTNPEPARGGRDCAGPRSDSKYCQSPECPAVPTTEPGPGVAGAEEEEGFGPWSPWSPCSKTCTHPERPATKTRERPCVGTAVCSGDGFQEQPCNLPLCSDVPPCQGEDCAGLNCSWAPWGPWTECSRSCGVGRQQRLRAYSPPGASGRWCPGILSAFVQRRFCSLQACKVDGAWSAWSPWSRCDRTCGGGRAVRTRSCTRPPPKNGGQRCPGERHQLHLCNAQPCDDSCPPGMALVTCANHCPRHCGDLQEGIVCREEEHCEPGCRCPNGTLEQDGGCVPLAHCECTDAQGHGWVPGSTHHDGCNNCTCLEGRLRCTDRLCPPLRCPWSRWSRWSPCSVTCGDGQQTRFRTPTAGSWDEECQGEQMENRGCAAGPCPPLCPQGSWERRLGDMWLQGECQRCTCTPEGTVCEDTTCAGAEHCTWGTWSPCSRSCGTGLASREGSCPCPFPGPPGAVCNASTGDGARPHREVQACYLRPCPAECSWSAWSSWGGCSCSSPLQHRYRHRHGTGLCVGLDVELHPCNTSGCSESSCEPPFEFQPCSPPCARLCSTLQHPELCPAQSHCLPGCFCPQGLLEQRSACVPPEQCDCLHTNESGDLVTLSPGDIILLGCKECVCQDGALQCSSEGCQGLLPLSPWSEWTPCSTCLPLFPSHLGDATPHVSVQHRYRACLDPQSGQPWSGDTAVCSAELQQQRLCPDPDICQELCLWSPWGPWGPCQQPCSGSFRLRHRHLQRLAGSGQCQGAQTQSESCNTAVCPGEDCEKQGRVFATTCANSCPRACADLWQHVECVQGGCKPGCRCPQGQLLQDGLCVPTAQCRCGLSGDNGTQELWPGQEATIECHNCTCENGTMVCPALPCPSYGPWSTWSPCSSSCGSGRTSRHRTCEPNPGGVPCMASGMQETAECSPQPCPAGCQLSPWSPWSPCSSSCGGGRSERSRELLGGEEEPCPIPALRQHRVCNVHNCTQECPRSQVHRECANACPHACADLRPQTQCLPQPCQPGCACPPGQVLQDGACVPPEECRCTLDSTMPGVLNLSREEQEQEHAPGSRLQHRCNTCICIRGTFNCSQEECNVDCLWSPWSPWSPCSVTCGMGERLSHRHPLRQRLYEGAECLGPPVRRAACHLPDCACPEGERWQGHEVPPGCEQSCRDILDETPANCTPSPSPGCTCEPGHYRNSSGHCVPSTLCECLHQGQLHQPGSEWQEQCARCRCVDGKANCTDGCTPLSCPEGEVKVREPGRCCPVCRMEWPEEPSSMCRRFTELRNITKGPCSLPNVEVSFCSGRCPSRTAVTPEEPYLQTLCECCSYRLDPGSPVRILSLPCAGGAAEPVVLPIIHSCECSSCQGGDFSKR

SEQ ID NO: 37 - protein, 171 aa, Xenopus tropicalis
GLPGKNSPRGSNALVGLPGKNSPRGSNVLVGLPGKNSPRGSNVLVGLPGKNSPGQQRDIGLPGKNSPRGSNALVGLPGKNSPRGSNALVGLPGKNSSNVLVGLPGKNSPRGSNALVGLPGKNSPRGSNVLVGLPGKNSPRGSNAIVGLPGKNSPRGSNVLVGLPGKNSPGQ

SEQ ID NO: 38 - protein, 352 aa, Xenopus tropicalis
AGYGGGYGFGAGYMAAGGGHRSGFGEEPGLLSLNEKITMQNLNDRLATYLNKVKSLEEANTDLEKKIRNWYDTHGPSPVQEKDYGPFYRTIEDLQKKILGATIDNGRIVLQIDNAKLAADDFRMKYENELILRQTVESDINGLKRLLDDLTLNRSDLESQLENLKEELAGLKKNHEEEMKALKVQLVGDVTVDMKAAPGIDLQKVLGDLRHDYEQIMQKNQKDIEFWYQEKTAELRKNVSGSTQEIQTTNTQVTELRRTLQNLEIDLQAQLSTKAALEASLAETEGRYCLQLSQLQALIQNVEAELANIRCEMENQSHEYKILLDIKTRLEQEINTYRNLLDGQGTQYGNHL

SEQ ID NO: 39 - protein, 89 aa, Xenopus tropicalis
TDTSPLCPYTDNSPLCPYTDTSPLCPYTDTSLLCPYTDTSLLCPYTDTSLLCPYTDTCPLCPYTDTSPLCPYTDTSPLCPYTDTSLLCP

SEQ ID NO: 40 - protein, 119 aa, Xenopus tropicalis
LTADYHTHLPVLTADYHTHLPVLTADYHTHLPVLTADYHTHLPVLTADCHTHLPVLTADYHTHLPVLTADYHTHLPVLTADYHTHLPVLTADYHTHLPVLTADYHTHLPVFSADYHTHL

SEQ ID NO: 41 - protein, 1708 aa, Xenopus tropicalis
MEPVSVPGFRLKAAAGGGTLFAWIVLYISCCLDISQGATEDVNVLQKLGLMGEKSSVRSVPQGVIPFKLGVILTQRARVEAPVHSILPPSLGTNLTLVLSLSSHRINNAFLFAVKSKKKKLELGVQFIPGKIIVYVGHKRSVYFDYNVHDGQWHNMALGIQGQTVTLYTSCGKQRVNASLHSRKVGPLDSDGVFILGKMNQHSIQFEGALCQFDIYPPAKAAHNYCKYLKKQCRQTDTYRPNLPHLIPLILNESRFHLGTEMPSRSVHNLTTILPRAELIGTSFSTSTKRIASGRLPFVKMTTKSPSLLASTSRPPYRIDTQLSSSTVTRTSTTVSGSSTSLPVNPLLEETVFNMAKSGLTPSQSTKKVYQKTTTKPSVTSAASKQVKKTTGSRRSTNTITPKQAVEKLNSGSSLKNHSYVDWKVKSNTSVLYTKPPSSSVPPSTHMVSASSPFAHDYYWLDPTPFPFLMGPPGPKGNQGSPGPPGLPGLTGSPGKRGPRGPPGPHGNPGPPGMHGPKGQKGDPGLSPGKAINGLKAFAHRMLCLQGDPGLPGLTGVPGPLSRKGQKGYPGPQGHPGEPGVRGPEGSPGAKGYPGRQGLPGPIGVSGPKGNRGYIGPPGLFGLPGADGERSWTPGRAEPTGRPRQPSRPPRPCTSIAQTSPRLWVLARMRSSNERWGGDVRCDTTQNGLQNRVWLLFVSNHTDCPKIQPHAHIFWLEKNWKVQGLPGVPGKRGTMGRPGFPGDFGERGPPGLDGNPGELGAPGPPGVPGFIGDMGAVGAVGFPGLKGLKGIQGFPGIPGDIGFQGDKGSQGLPGPPGMRGKTGVMGKPGDKGFAGFPGPPGPEGFPGDIGPPGENGPEGIKGKPGARGFPGPRGQPGHEGDEGPIGPPGAPGLEGFPGRKGYPGILGAEGPKGEAGNTGRSGKIGEQGLQGFIGPVGETGIAGEKGDRGGIGSPGPPGEKGTMGHPGNPGPPGSPGPPGPPGSPGSRGSPGVRGPKGRRGARGPDGPAGEPGLAGTKGKMGERGIPGPNGFPGPAGAQGPVGALGEIGHKGPQGAKGEPGPPGETGLKGDLGPLGIPGEQGLIGQRGDPGLEGESGLTGPDGMKGEIGQPGPEGEKGEKGVEGTKGKDGPPGPSGIPGVRGEIGQPGPEGEKGEKGVEGTKGKDGPPGPSGIPGVRGVEGKPGKQGEKGKPGQKGSKGFEGHLGETGVPGDQGPTGNQGPKGSRGTRGPVGSPGRMGAQGEPGMPGYQGEQGDDGKAEGTPGAPGDRGPVGDGGDRGEPGDPGYPGHSGPRGLQGLRGSKGTVGLKGKPGKPGESGAHGQPGAIGVTGPRGVVGRQGQEGPAGPDGIPGKDGSPGLKGEQGDDGEIGLAGTLGKRGNTGVPGLPGAQGPPGFRGERGLPGEIGLPGKRGMEGGMGLSGAKGELGTKGQPGDPGEMGFPGIAGLFGPKGPPGDVGFKGIQGPKGPLGLMGKEGAGGPMGIVGPNGNPGMPGPRGPPGPRGKPGPPGPSVILDSYSYQSTNYMMVDNGSEIFKTLHYLSSLIQSIKSPLGTRDNPARICRDLMNCQQKMGDDTIEVTCNFTEGGQTCLKPITKSKMEFEVGRVQMNFLHLLSSEAMQSITFHCLNVPAWEKSSKAVRFKAWSGHIFGTEGMFQPEVSVDGCKVQDGRWHQTVLIFRTQDPTQFPIVDVLNLPLPSPGMTIHLEVGSVCFL

SEQ ID NO: 42 - protein, 1626 aa, Homo sapiens
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYGIPQVSIRLDGENKAVEYNAVGAMKDAVRVVFRGSRVNDLFDRDWHKMALSIQAQNVSLHIDCALVQTLPIEERENIDIQGKTVIGKRLYDSVPIDFDLQRIVIYCDSRHAELETCCDIPSGPCQVTVVTEPPPPPPPQRPPTPGSEQIGFLKTINCSCPAGEKGEMGVAGPMGLPGPKGDIGAIGPVGAPGPKGEKGDVGIGPFGQGEKGEKGSLGLPGPPGRDGSKGMRGEPGELGEPGLPGEVGMRGPQGPPGLPGPPGRVGAPGLQGERGEKGTRGEKGERGLDGFPGKPGDTGQQGRPGPSGVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKAACGKVRGSENCALGGQCVKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 43 - protein, 1391 aa, Pan troglodytes
  misc_feature (583)..(706): Xaa can be any naturally occurring amino acid
MHNPEDRIARPKSPCRGTCVHNPEDGTAGQKGLLGGTFPGTPSVRGNPSVPGAPQSRKPPQSLEPLSQETRQSREPPQSLEPLSPGKPLSQETPQSREPPQSWEPLSPGTPSVPGTPQSRETLSPETPQSQEPPQSREPLSPGNPLSPWNPSVPGTPQSGNPSVPGNPSVLGSPSVPGTLQSREPPQSLEPLSPGNPLSPWNPSVPETPQSREPPQSLEPLSPGNPLSPRKPLSPGTPSVPRAPQSWNPSVPGAPQSREPPQSRNPLSPESPSVLEPLQSQEPPQSREPPQSREPFSPGNALSPWNPSVPGTPSVPGTPQSRKPLSPGNPLSPWNPSVPGTPSKFPSREALRTLPTQLRGRPWGLFEPEASEPRREAPGLDMGPPGALPSFLGHTTMEARTSGEILRECPRKPPQSRETPQSGNPSVPGTPSVPGNPSVPGAPQSREPPQSLEPLSPGNPSVPGTPSVPGTPQSREPPQSLEPLSPGNPSSREPLSPGTPQPESPSVLEPLQSQEPPQSREPPQSREPFSPGNPLSPWNPSVPGTPSVPGTPQSRKPLSPGNPLSPWNPSVPGTPSVPGNPSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSPGSPSVPGAPQCREPFSSGASSVPGDHQSPGAHSVPEPRQFREPLSPGSAISPGTPPGSPSVPGNPSVPGTPSVPGNPSVPGKWWRAGQVCFGCRHGGWGTCREDALEERSEQLSRRTSAAVVRPEAGRGGGAASGHIAERSKGLGRKAGALASTCLLQRTFWLNTWKMPTSFAEKGRVGGGEKGGGGGAPAAGGRGSVLELQRGRQCSHDRPTHPPVRPGRGAVWTQYNEGDGHLCPSAPQCNEGDGHHCPSAPDTMRVMATSAHLPLDAMRGKVTTAHSPSDARKGTATSAHPPLDAMRGKVTTAHSPSDARKGTATTALPPPNTRPHRCHPMRTTSSLYLASPRAFGKSRWHEVGWCRPHRVSGGPVSCSKGHPRTLSYRPSREMSPFSLSSWHICRPPMGSPPRDLPAGHPPSPSCPWALPTATLGHGLCLPYHQMLTGMGWTTSPSGRRLDAGTSDVEAARLRLARWWHCCPEASVPTSTQAPRRSPPGSPASLDVTLLPSPLHLWCAAPTVVLRAWTSTCTCGVWHPLSSSGPGHHPPALTIPPVVCSTHCHPQDLDVTLLPSPFHLWCVAPTVVLRAWMSPSCPHCSTCGVWHPLSSSGPGRHPPALTIPPVVCGTHCCPQALNVSPQPCPMGLPSCKMHRAAEDSQGGSSRHLASPHCKTKPVPTIVSESRGNFVI

SEQ ID NO: 44 - protein, 4007 aa, Homo sapiens
MGVSKVWLGLALALAEFAVLPHHSEGACVYQGSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSGVGIPSGECLAQCRAHFYLESTGLCEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIERKNDEPPRMTLQPLRVQLSSGVVISNSSLSLQDLDTPDNELIFVLTKKPDHGHVLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGQPEYSHGTGEPGGSFAFKFDVVDGEGNRLIDKSFSISISEDKSPPVITTNKGLVLDENSVKKITTLQLSATDQDSGPTELIYRITRQPQLGHLEHAASPGIQISSFTQADLTSRNVQYVHSSEAEKHSDAFSFTLSDGVSEVTQTFHITLHPVDDSLPVVQNLGMRVQEGMRKTITEFELKAVDADTEAESVTFTIVQPPRHGTIERTSNGQHFHLTSTFTMKDIYQNRVSYSHDGSNSLKDRFTFTVSDGTNPFFIIEEGGKEIMTAAPQPFRVDILPVDDGTPRIVTNLGLQWLEYMDGKATNLITKKELLTMDPDTEDAQLVYEITTGPKHGFVENKLQPGRAAATFTQEDVNLGLIRYVLHKEKIREMMDSFQFLVKDSKPNVVSDNVFHIQWSLISFKYTSYNVSEKAGSVSVTVQRTGNLNQYAIVLCRTEQGTASSSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAICYTVPKSAMGSSFYALESGSDFKSRGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGLAEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTNRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGASIGSALAAIMLLLLVFLVACFINRKCQKQRKKKPAEDILEEYPLNTKVEVPKRHPDRVEKNVNRHYCTVRNVNILSEPEAAYTFKGAKVKRLNLEVRVHNNLQDGTEV

SEQ ID NO: 45 - protein, 351 aa, Cowdria ruminantium
MVHSTAEDCMLHLTTRIDNIDFGNDLSIYSNNQFSVSNGDITMEIGYHPHEHEEGHENHHGEYHVMFTSNGHVLSDFHGVTGKHIALDVLNHSLQASFVVNLMEPFSEFLQQGSNFSLNLHPLNVCYDKVISGVDTTVTNSPEGAAVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEGSVVTSSPEVAKGFTFGGRSGERVFTGI

SEQ ID NO: 46 - protein, 1624 aa, Mus musculus
MRLWSWVLRLGLLSAALGCGLAERPRRVRRDPRAVRPPRPAAGPATCATRAARGRRASPPPPPGGAWEAVRVPRRRQQRAARGAEEPSPPSRALYFSGRGEQLRLRADLELPRDAFTLQVWLRAEGGQKSPAVITGLYDKCSYTSRDRGWVMGIHTTSDQGNRDPRYFFSLKTDRARKVTTIDAHRSYLPGQWVHLAATYDGRLMKLYMNGAQVATSAEQVGGIFSPLTQKCKVLMLGGSALNHNFRGHIEHFSLWKVARTQREIVSDMETRGLHTPLPQLLLQENWDNVKRTWSPMKDGNSPQVEFSNAHGFLLDTNLEPPLCGQTLCDNTEVISSYNQLPSFRQPKVVRYRVVNIYDDHHENPTVSWQQIDFQHQQLAEAFQHYNISWELEVLNINSSSLRHRLILANCDISKIGDEKCDPECNHTLTGHDGGDCRQLRYPAFMKKQQNGVCDMDCNYERFNFDGGECCDPDITDVTKTCFDPDSPHRAYLDVNELKNILRLDGSTHLNIFFANSSEEELAGVATWPWDKEALMHLGGIVLNPSFYGIPGHTHTMIHEIGHSLGLYHIFRGISEIQSCSDPCMETEPSFETGDLCNDTNPAPKHKFCGDPGPGNDTCGFHGFFNTPYNNFMSYADDDCTDSFTPNQVSRMHCYLDLVYQSWQPSRKPAPVALAPQVVGHTMDSVMLEWFPPIDGHFFERELGSACDLCLEGRILVQYAFNASSPMPCGPSGHWSPREAEGHPDVEQPCKSSVRTWSPNSAVNPHTVPPACPEPQGCYLELEFRYPLVPESLTIWVTFVSSDWDSSGAVNDIKLLTISGKNISLGPQNVFCDIPLTIRLRDVGEEVYGIQIYTLDEHLEIDAAMLTSTVDSPLCLQCKPLQYKVLRDPPLLEDVASLLHLNRRFMDTDLKLGSVYQYRIITISGNEESEPSPAAIYTHGSGYCGDGVIQKDQGEECDDMNKVNGDGCSLFCKQEVSFNCIDEPSRCYFHDGDGMCEEFEQKTSIKDCGVYTPQGFLDQWASNASVSHQDQQCPGWVVIGQPAASQVCRTKVIDLSEGISQHAWYPCTITYPYYHLPQTTFWLQTYFSQPMVAAAVIIHLVTDGTYYGDQKQETISVQLLDTKDQSHDLGLHVLSCRNNPLIIPVVHDLSQPFYHSQAVHVSFSSPLVAISGVALRSFDNFDPVTLSSCQRGETYSPAEQSCVHFACQAADCPELAVGNASLNCSSNHHYHGAQCTVSCQTGYVLQIQRDDELIKSQVGPSITVTCTEGKWNKQVACEPVDCGIPDHHHVYAASFSCPEGTTFGRRCSFQCRHPAQLKGNNSFLTCMEDGLWSFPEALCELMCLAPPPVPNADLQTARCRENKHKVGSFCKYKCKPGYHVPGSSRKSKKRAFKTQCTQDGSWQEGTCVPVTCDPPPPKFHGLYQCTNGFQFNSECRIKCEDSDASQGRGSNIIHCRKDGTWSGSFHVCREMQGQCSAPNQLNSNLKLQCPDGYAIGSECAISCLDHNSESIILPVNLTVRDIPHWMNPTRVQRIVCTAGLQWYPHPALIHCVKGCEPFMGDNYCDAINNRAFCNYDGGDCCTSTVKTKKVTPFPMSCDLQNDCACRDPEAQEHNRKDLRGYSHG

SEQ ID NO: 47 - protein, 1313 aa, Homo sapiens
MSGWRYLICVSFLLTILLELTYQGPPVPASSSTKLLMTSYSMRSTVVSRYAHTLVTSVLFNPHAEAHEAIFDLDLPHLAFISNFTMTINNKVYIAEVKEKHQAKKIYEEAHQQGKTAAHVGIRDRESEKFRISTSLAAGTEVTFSLAYEELLQRHQGQYQLVVSLRPGQLVKRLSIEVTVSERTGISYVHIPPLRTGRLRTNAHASEVDSPPSTRIERGETCVRITYCPTLQDQSSISGSGIMADFLVQYDVVMEDIIGDVQIYDDYFIHYFAPRGLPPMEKNVVFVIDVSSSMFGTKMEQTKTAMNVILSDLQANDYFNIISFSDTVNVWKAGGSIQATIQNVHSAKDYLHCMEADGWTDVNSALLAAASVLNHSNQEPGRGPSVGRIPLIIFLTDGEPTAGVTTPSVILSNVRQALGHRVSLFSLAFGDDADFTLLRRLSLENRGIARRIYEDTDAALQLKGLYEEISMPLLADVRLNYLGGLVGASPWAVFPNYFGGSELVVAGQVQPGKQELGIHLAARGPKDQLLVAHHSEGATNNSQKAFGCPGEPAPNVAHFIRRLWAYVTIGELLDAHFQARDTTTRHLLAAKVLNLSLEYNFVTPLTSLVMVQPKQASEETRRQTSTSAGPDTIMPSSSSRHGLGVSTAQPALVPKVISPKSRPVKPKFYLSSTTTASTKKMLSSKELEPLGESPHTLSMPTYPKAKIPAQQDSGTLAQPTLRTKPTILVPSNSGTLLPLKPGSLSHQNPDILPTNSRTQVPPVKPGIPASPKADTVKCVTPLHSKPGAPSHPQLGALTSQAPKGLPQSRPGVSTLQVPKYPLHTRPRVPAPKTRNNMPHLGPGILLSKTPKILLSLKPSAPPHQISTSISLSKPETPNPHMPQTPLPPRPDRPRPPLPESLSTFPNTISSSTGPSSTTTTSVLGEPLPMPFTPTLPPGRFWHQYDLLPGPQRTRQVLGPSRPGVPTMSLLNSSRPTPEGSPPNLPILLPSSILPEAISLLLLPEELELLSESMVESKFVESLNPPAFYTFLTPDEDGSPNWDGNSEEILGGAGGSMESQGSSVGLAKGTLPSIFTFSSSVDGDPHFVIQIPHSEEKICFTLNGHPGDLLQLIEDPKAGLHVSGKLLGAPPRPGHKDQTRTYFQIITVTTDKPRAYTITISRSSISLRGEGTLRLSWDQPALLKRPQLELYVAAAARLTLRLGPYLEFLVLRHRYRHPSTLQLPHLGFYVANGSGLSPSARGLIGQFQHADIRLVTGPMGPCLRRHHGPDVPVILGKRLLKDSPRLLPRWASCWLVKRSHVELLLGHPYLSYVL

SEQ ID NO: 48 - protein, 689 aa, Homo sapiens
MIAAAFLVLLRPYSIQCALFLLLLLLGTIATIVFFCCWHRKLQKGRHPMKSVFSGRSRSRDAVLRSHHFRSEGFRASPRHLRRRVAAAAAARLEEVKPVVEVHHQSEQETSVRKRRIKKSSRVQPEFYHSVQGASIRRPSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFA

SEQ ID NO: 49 - protein, 739 aa, Mus musculus
MVAERTRKAAASGSRGPGELGAPGPGTVALAEQCARLPSPGCCGLLALALCSLALSLLAHFRTAELQARVLRLEAERGEQQMEKAILGRVNQLLDEKWKFYSRRRREAPKMSPGCNCPPGPPGPTGRPGLPGDKGAIGMPGRVGIKGQPGEKGAPGDAGMSIVGPRGPPGQPGTRGFPGFPGPIGLDGRPGHPGPKGEMGLVGPRGQPGPQGQKGEKGQCGEYPHREYPGGMLAALRSNPIMSLKLLPLLNSVRLAPPPVIKRRTFQGEQSQTGIQGPPGPPGPPGPSGPLGHPGLPGPIGPPGLPGPPGPKGDPGIQGYHGRKGERGMPGMPGKHGAKGVPGIAVAGMKGEPGTPGTKGEKGAAGSPGLLGQKGEKGDAGNAIGGGRGEPGPPGLPGPPGPKGEAGVDGQAGPPGQQGDKGQPGAAGEQGPSGPKGAKGEPGKGEMVDYNGSINEALQEIRTLALMGPPGLPGQTGPPGPPGTPGQRGEIGLPGPPGHDGDKGPRGKPGDMGPAGPQGPPGKDGPPGMKGEVGPPGSPGEKGETGQAGPQGLDGPTGEKGEPGDEGRPGATGLPGPIGLPGFTGEKGEAGEKGDPGAEVPGPPGPEGPPGPPGLQGFPGPKGEAGLEGSKGEKGSQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 50 - protein, 5636 aa, Homo sapiens
MISWEVVHTVFLFALLYSSLAQDASPQSEIRAEEIPEGASTLAFVFDVTGSMYDDLVQVIEGASKILETSLKRPKRPLFNFALVPFHDPEIGPVTITTDPKKFQYELRELYVQGGGDCPEMSIGAIKIALEISLPGSFIYVFTDARSKDYRLTHEVLQLIQQKQSQVVFVLTGDCDDRTHIGYKVYEEIASTSSGQVFHLDKKQVNEVLKWVEEAVQASKVHLLSTDHLEQAVNTWRIPFDPSLKEVTVSLSGPSPMIEIRNPLGKLIKKGFGLHELLNIHNSAKVVNVKEPEAGMWTVKTSSSGRHSVRITGLSTIDFRAGFSRKPTLDFKKTVSRPVQGIPTYVLLNTSGISTPARIDLLELLSISGSSLKTIPVKYYPHRKPYGIWNISDFVPPNEAFFLKVTGYDKDDYLFQRVSSVSFSSIVPDAPKVTMPEKTPGYYLQPGQIPCSVDSLLPFTLSFVRNGVTLGVDQYLKESASVNLDIAKVTLSDEGFYECIAVSSAGTGRAQTFFDVSEPPPVIQVPNNVTVTPGERAVLTCLIISAVDYNLTWQRNDRDVRLAEPARIRTLANLSLELKSVKFNDAGEYHCMVSSEGGSSAASVFLTVQEPPKVTVMPKNQSFTGGSEVSIMCSATGYPKPKIAWTVNDMFIVGSHRYRMTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVATNIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEDGTLLVIASVTPYDNGEYICVAVNEAGTTERKYNLKVHVPPVIKDKEQVTNVSVLLNQLTNLFCEVEGTPSPIIMWYKDNVQVTESSTIQTVNNGKILKLFRATPEDAGRYSCKAINIAGTSQKYFNIDVLVPPTIIGTNFPNEVSVVLNRDVALECQVKGTPFPDIHWFKDGKPLFLGDPNVELLDRGQVLHLKNARRNDKGRYQCTVSNAAGKQAKDIKLTIYIPPSIKGGNVTTDISVLINSLIKLECETRGLPMPAITWYKDGQPIMSSSQALYIDKGQYLHIPRAQVSDSATYTCHVANVAGTAEKSFHVDVYVPPMIEGNLATPLNKQVVIAHSLTLECKAAGNPSPILTWLKDGVPVKANDNIRIEAGGKKLEIMSAQEIDRGQYICVATSVAGEKEIKYEVDVLVPPAIEGGDETSYFIVMVNNLLELDCHVTGSPPPTIMWLKDGQLIDERDGFKILLNGRKLVIAQAQVSNTGLYRCMAANTAGDHKKEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNRLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSAQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVAGKTEKKNYNVNIWVPPNIGGSDELTQLTVIEGNLISLLCESSGIPPPNLIWKKKGSPVLTDSMGRVRILSGGRQLQISIAEKSDAALYSCVASNVAGTAKKEYNLQVYIRPTITNSGSHPTEIIVTRGKSISLECEVQGIPPPTVTWMKDGHPLIKAKGVEILDEGHILQLKNIHVSDTGRYVCVAVNVAGMTDKKYDLSVHAPPSIIGNHRSPENISVVEKNSVSLTCEASGIPLPSITWFKDGWPVSLSNSVRILSGGRMLRLMQTTMEDAGQYTCVVRNAAGEERKIFGLSVLVPPHIVGENTLEDVKVKEKQSVTLTCEVTGNPVPEITWHKDGQPLQEDEAHHIISGGRFLQITNVQVPHTGRYTCLASSPAGHKSRSFSLNVFVSPTIAGVGSDGNPEDVTVILNSPTSLVCEAYSYPPATITWFKDGTPLESNRNIRILPGGRTLQILNAQEDNAGRYSCVATNEAGEMIKHYEVKVYIPPIINKGDLWGPGLSPKEVKIKVNNTLTLECEAYAIPSASLSWYKDGQPLKSDDHVNIAANGHTLQIKEAQISDTGRYTCVASNIAGEDELDFDVNIQVPPSFQKLWEIGNMLDTGRNGEAKDVIINNPISLYCETNAAPPPTLTWYKDGHPLTSSDKVLILPGGRVLQIPRAKVEDAGRYTCVAVNEAGEDSLQYDVRVLVPPIIKGANSDLPEEVTVLVNKSALIECLSSGSPAPRNSWQKDGQPLLEDDHHKFLSNGRILQILNTQITDIGRYVCVAENTAGSAKKYFNLNVHVPPSVIGPKSENLTVVVNNFISLTCEVSGFPPPDLSWLKNEQPIKLNTNTLIVPGGRTLQIIRAKVSDGGEYTCIAINQAGESKKKFSLTVYVPPSIKDHDSESLSVVNVREGTSVSLECESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNHKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTLVDTSINIECRATGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQIAFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKAIGFVYVKEPPVFKGDYPSNWIEPLGGNAILNCEVKGDPTPTIQWNRKGVDIEISHRIRQLGNGSLAIYGTVNEDAGDYTCVATNEAGVVERSMSLTLQSPPIITLEPVETVINAGGKIILNCQATGEPQPTITWSRQGHSISWDDRVNVLSNNSLYIADAQKEDTSEFECVARNLMGSVLVRVPVIVQVHGGFSQWSAWRACSVTCGKGIQKRSRLCNQPLPANGGKPCQGSDLEMRNCQNKPCPVDGSWSEWSLWEECTRSCGRGNQTRTRTCNNPSVQHGGRPCEGNAVEIIMCNIRPCPVHGAWSAWQPWGTCSESCGKGTQTRARLCNNPPPAFGGSYCDGAETQMQVCNERNCPIHGKWATWASWSACSVSCGGGARQRTRGCSDPVPQYGGRKCEGSDVQSDFCNSDPCPTHGNWSPWSGWGTCSRTCNGGQMRRYRTCDNPPPSNGGRACGGPDSQIQRCNTDMCPVDGSWGSWHSWSQCSASCGGGEKTRKRLCDHPVPVKGGRPCPGDTTQVTRCNVQACPGGPQRARGSVIGNINDVEFGIAFLNATITDSPNSDTRIIRAKITNVPRSLGSAMRKIVSILNPIYWTTAKEIGEAVNGFTLTNAVFKRETQVEFATGEILQMSHIARGLDSDGSLLLDIVVSGYVLQLQSPAEVTVKDYTEDYIQTGPGQLYAYSTRLFTIDGISIPYTWNHTVFYDQAQGRMPFLVETLHASSVESDYNQIEETLGFKIHASISKGDRSNQCPSGFTLDSVGPFCADEDECAAGNPCSHSCHNAMGTYYCSCPKGLTIAADGRTCQDIDECALGRHTCHAGQDCDNTIGSYRCVVRCGSGFRRTSDGLSCQDINECQESSPCHQRCFNAIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDINECEQVPKPCAHQCSNTPGSFKCICPPGQHLLGDGKSCAGLERLPNYGTQYSSYNLARFSPVRNNYQPQQHYRQYSHLYSSYSEYRNSRTSLSRTRRTIRKTCPEGSEASHDTCVDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHPRTTFLMVDEEQTVPFALRDENLKGVVYTTRPLREAETYRMRVRASSYSANGTIEYQTTFIVYIAVSAYPY

SEQ ID NO: 51 - protein, 1691 aa, Homo sapiens
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 52 - protein, 912 aa, Xenopus laevis
MTDSSGKTKSLHASIGTLAISAGSFLLAINYYSWTTATTVIPSTALGILLLIVAAILAYVGIRKCRTNASLCVLFYWTVSALWFSSGINFILAGNNVFSNTNLNTVSTLSGTNFPLAGNPDMTNANVPGLIAFAVGLFIIGIMGILQNETPLALMAIALSLSSIHETVLLYKVNFGASAIACNYLIVTLIGLYFVAGRVVSILSKGQFNLPGTSLTEKADQEQGTMKGLSRIEFEATYLLLNMVSSSVFACRLLGITNSLFVGQVPWLWTAAVFQTAICILSYRYYNMLDAPQLPFSSILRFAEGYSLLYQFFNTGEPNFPLPFLIVFAVLFFILSLFTSLKSLIDSGYLLLFVAYCIALACSPQAFFHGGSQGVNVAIFLFSAILLLIKLYNSKSSAKICIGEGIIEKLFARNSFFKLRQGKSIHEPFLGFSKYADADVLAHACSVLAAFAMTMPGTSSTPLLTVVLPWVVVSGGIYHLICGSVAFSRGKTLESSAFILYGVMWVIWGLTRYGGLYGTSRGFNTAVGIISFLLFNSFIVFSTLFLTKAWFAYSLTFQLILISFLLDSLNALPQGYDIAITIIFGLVSFYCFLATLFNSVFEGPQIPVGSPFIKISGFSNDKSKCPHVVSTRTSSVRQIAEIMKNGGICGIPTDTVYVLVAACNQPDAVEKAYKTKRQAQDRPMSLWISSLEQLASAKHLFSPLLWDFMHKAWPSSISLVIPRGPWLEVLGAKESSKYIGTPQSIAIRIPDCTVTTHLIDMVGPIAVTSANPSGEADTTHHNQVFAKLGDKVDGVLCDGPSPENIASTVVDCTKIDSGNLGFFRVGIVPKSQVLQIFEEVKNRNTFGYENSAFVGSTDQLDNSADNSNPELYAEIEAKETTDQLQNCDGNSNPQPKAYVNGGFALNEKDLKL

SEQ ID NO: 53 - protein, 1755 aa, Homo sapiens
METRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHELRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPRKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGQQEPAKAAVAFRVSPNSGLLEARSANAPPTSIALQVFFTARSSELYESTMVVEGVLGEKSCTLRLRGQGSYDERYMLPHQP

SEQ ID NO: 54 - protein, 1171 aa, Xenopus tropicalis
MTSLQRKLPEWMSVQQKEDSIDDKKKSLWKKNIVEDNLPYLKFNGSIVYSYEGNDCSLLSEDIRSSLQEEDVLGFDIEWPPIYTKGKTGKVALIQVCVSEKKCYLFHISPMAGFPKGLRRLLEDESVKKVGVGIEGDQWKLMSDYELKLKGFIELSEVANQKLRCKEKWSLNGLVKHLFKKQLLKDSSIRCSNWDIFPLSTDQKLYAASDAYAGLLIYQKLECMDAHEKVSFCVSRGIKRQLTDLSNGFMDLVKDVPSSFGHSTGALRAVAILEDLSEKLEELRSIVKEASKGEGNGLLCHDSEDCSEEDKYQSINLASKELLAENKIDYKNAESKNNKDVDCCQNENMKQDFLGISEEELYMMERKDDENQIKPGQKSNEHLYDTNEEKNMSYIIESDEEFESEIIKSLEDLDNSIEEAIGTSVHQTGLIPAKSVDTVADEEEDEGIEEEDDDDDWDPSIPEPNAEQVSCLKTYFGHSSFKPVQWKVIHSVLRERRDNLVVMATGYGKSLCYQFAPVYTSGIGIVICPLISLMEDQVLQLEMSNIPSCFLGSAQSKNVLQDVKAGRMRVIYMTPEFCSGGISLLQDLDNRYGITLIAIDEAHCISEWGHDFRSAYRSLGSLKRMLPTVPIVALTATASPSIREDISKSLSLHNPQITCTSFDRPNLYLDVAKKTTNISTDLQQFLIKKQGSGWEFEGATIVYCPTRKTSEQVTAELTKLGIACGTYHAGMGIKQRRDVHHRFMRDEIQCVVATVAFGMGINKPDIRKVIHYGAPKEMESYYQEIGRAGRDGLPSCCHALWTQADINFNRHMLGEIPNNSFREYKLKMLTKMEKYLNSSNCRRKIILSHFEDKQLRKASSGIMGTEKCCDNCKTRLRFNISINDTEDNLQEFGQQAYKFISAVDILGQKFGTGVPVLFLRGSTSQRLPDRFRHHPLFSCGKDQTEAFWKVLARQLISEGYLQESSGHTKFSTICGLTSKGTNWLMKASNQQHPSLLLPSNDELCLRRTTVSNSISRVPSHSSMIPHASPNTRSSIPKAGPEKISLKEKFSYQEAGKLSTAVDVSKSSLKLQTPCKPLQAAEPDVSPKEMELQTALYGRLVVARQKIASERDIPPAVLATNKVLVDMAKLRPTTIENMKKLDGVSEAKSAMLAPLVEVVKEFCIANSLKMDI

SEQ ID NO: 55 - protein, 1096 aa, Homo sapiens
MATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 56 - protein, 583 aa, Mus musculus
MVHSSMGAPEIRMSKPLEAEKQSLDSPSEHTDTERNGPDINHQNPQNKASPFSVSPTGPSTKIKAEDPSGDSAPAAPPPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPTSYSPHLVTPQGGAGTLPLSQASSSLSTTVTTLSSAVGTLHPSRTAGGGGGGGGAAPPLNSIPSVTPPPPATTNSTNPSPQGSHSAIGLSGLNPSAGSTMVGLSSGLSPALMSNNPLATIQALASGGTLPLTSLDGSGNLVLGAAGAAPGSPSLVTSPLFLNHTGLPLLSAPPGVGLVSAAAAAVAASISSKSPGLSSSSSSSSSSTCSDVAAQTPGGPGGPEAGSKAE

SEQ ID NO: 57 - protein, 373 aa, Homo sapiens
MATQAHSLSYAGCNFLRQRLVLSTLSGRPVKIRKIRARDDNPGLRDFEASFIRLLDKITNGSRIEINQTGTTLYYQPGLLYGGSVEHDCSVLRGIGYYLESLLCLAPFMKHPLKIVLRGVTNDQVDPSVDVLKATALPLLKQFGIDGESFELKIVRRGMPPGGGGEVVFSCPVRKVLKPIQLTDPGKIKRIRGMAYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFKIETKPCGEELKGGDKVLMTCVGIGFSNLSKTLK

SEQ ID NO: 58 - protein, 784 aa, Xenopus tropicalis
MLKKEYKDDLEKTKPKASGNSTVDGDSFMNRSLPPKDGIQEDIAVGSDLGEEEMEVESEKEEEKPKAGSFTNAVSSLNVLRPGEIPDAAFIHAARKKRQMARELGDAPSVDGEGGGKSRLVREDENDASDDEDDDKRRIVFSVREKSQRQKIAEEIGIEGSDDEALATGDQDEELSRWEQEQIRKGISIPQVQAPQPPETNMFYPSTYQGMPYGTSYGVPYTYAAYGSTETKSQKPDNSVSFKTPSNEMTPVTIDLVKKQLKDRLDAMKEVHKANLEQYEKHVQSREDSTSSISRLEGCSGSNAERYQFLQEMRGYVQDLLECFREKVPLINELESAMHQLYKQRAARLVQRRQDDIKDESSEFSSHSSKAVMAPNLDPFGRDRALFQEHAKQRRIAEREARRTRRRQAREVPGKTAEHLEGLSSDDEETSTDITNFNMEKDRILKEAGKVFEDTLENFHSIEYIKDQFESWRSTYYSTYKDAYIGLCLPKLLNPLVRIQLLTWNPLEANCCNFESMMWFECLLFYGCEEKEYDKEDVDIVLLPSLVEKVILPKLAGIAENVWDPFSTTQTNRLAAVVQKLVNGYPTVLNSENKNTEALLKALLARMRRTLDDDVFMPLYPKNVIENKNSAPCIFFQRQFWSSVKLLGNFLKWHGVLSNKALQELSVDGLLNRYILMAFQNNENGEDSIKKAQSVITCFPRQWFANLKGGKTIPQLENFARYLTHLAGTIYRNNVGCSDIERRNAREQIRQIVKLLASIRALESAMSVANDYNVKDIKAPTEGK

SEQ ID NO: 59 - protein, 434 aa, Xenopus tropicalis
MSTGTAESCGKNLPCRMDHLLTAVENELQVGSEKGDPTERELKVNLEDTDLWIRFKELTNEMIVTKNGRRMFPVLKISVTGLDPNAMYSFLMDFVTADNNRWKYVNGEWVPGGKPEPQAPSCVYIHPDSPNFGAHWMKAPVSFSKVKLTNKMNGEGQIMLNSLHKYEPRIHIVRVGGPQKMITSHSFPETQFIAVTAYQNEEITALKIKHNPFAKAFLDAKERSDHKDFIDDAENGQQSGYSQLGNWLIPGTGSLCSSSNHHSQFGAPLSIPSSHGCERYTTLRNHRSSPYPSPYTHRNNSPPSYTENSSACLPVFQSNDHWPGLQMQTHTGMLSINHTNGSPSNSCQYPSLWSVSNSTIAPLPQTGSVANGLGSQYLRSSTSLYAPYNQIVPSPTMGSPIYEGTPTEIEENQYDVTAHDRLAPSWASVTPPSL

SEQ ID NO: 60 - protein, 1911 aa, Canis familiaris
MADGKGDAAVAAGAGAEAPAGTGAGDGPETESMARGHRPASPAPGAPGLRPCLWQLETELREQEVSEVSSLNYCRSFCQTLLQYANNKNASEHMVYLLEVYRLAIQSFASARPYLTTECEDVLLVLGRLVLSCFELLLSVSESELPCEVWVLFLQSLQESHDALLEFGNNNLQILVHVTKEGVWKNPVLLKILSQQPVETEEVNKLIAQEGPSFLQMRIKHLLKSNCIPQATALSKLCAESKEISNVSSFQQAYITCLCSILPNEDAIKEIAKVDCKEILDIICNLESEGQDNTAFVLCTTYLTQQLQTASVYCSWELTLFWSKLQRRIDPSLDTFLERCRQFGVIAKTQQHLFCLIRVIQTEAQDAGLGVSILLCVRALQLRSSEDEEMKASVCKTIACLLPEDLEVRRACQLTEFLIEPSLDGFNMLEELYLQPDQKFDEENAPVPNSLRCELLLALKAHWPFDPEFWDWKTLKRHCHQLLGQEASDSDDDLSGYEMSINDTDVLESFLSDYEEGKEDKQYRRRDLTDQHKEKRDKKPIGSSERYQRWLQYKFFCLLCKRECIEARILHHSKMHMEDGIYTCPVCIKKFKRKEIFVPHVMEHVKMPPSRRDRSRKKLLLKGSQKGICPKSPSATLEQNQSLDEQAKGESHEYVTFSKLEDCHLQDRDLYPCPGTDCSRVFKQFKYLSVHLKAEHQNNDENAKHYLDMKNRREKCTYCRRHFMSAFHLREHEQVHCGPQPYMCVSIDCYARFGSVNELLNHKQKHDDLRYKCELNGCNIVFSDLGQLYHHEAQHFRDASYTCNFVGCKKFYYSKIEYQDHLSMHNVESSNGDVKKSVKLEEAAPGEKQDSINQPHLLDQTDKSHLPEDLLFCAGSANSQIETAENLKENSDSNSSDQLSHSSSASLNEELIDTLDHSETMQDILLSHEKVFVPSSLKEKCSSVAVCFDGTKFTCGFDGCGSTYKNARGMQKHLRKVHPYHFKPKKIKTKDLFPCLGNEHNQTTEKFDAEPKPSSDTNSDSPDEGLDHNIHTKCKREYQGYSTEASICASKRPCTEDTMLELLLRLKHLSLKNSMTHGSFSGSLQGYPSSGAKSLQSVSPISDLNFQNQDENMPSQYLAQLAAKPFFCELQGCKYEFVTREALLMHYLKKHNYSKEKVLQLTMFQHRYSPFQCHICQRSFTRKTHLRIHYKNKHQIGSDRVTHKLLDNEKCDHEGPCSVDRLKGDCPTELGRDPSSNSEKPHCHSKKDECSSETDLESSCEETESKTSDISSPIGSHREEGEGREGRGSRRTVAKGNLCYILNKYHKPFHCIHKTCNSSFTNLKGLIRHYRTVHQYNKEQLCLEKDKARTKRELVKCKKIFACKYKECNKRFLCSKALAKHCSDSHNLDHIEEPKVLSEAESAARFSCNQPQCPAVFYTFSKLKHHLMEQHNIEGEIHSDYEIHCDLNGCGQIFTHRSNYSQHVYYRHKDYYDDLFRSQKVANERLLRSEKVCPTALTQGHEHQTTRRSFNAKAKKCSLIKEKKAPISFKTRAEALHMCVEQSEHTQYPCMVQGCLSVVKLESSIVRHYKRTHQMSSAYLEQQMENLVVCVKYGTKIKEEPPSEADPYIKKEENSCESERTKHSHSPGDSSVPAQSTDSLHPGEREGGQKGCTESKPAFDADTLLYRGTLKCNHSSETTSLEQCNIVQPPPCKIENSIPNPSGTESGTYFTSFQLPLPRIKDSETGQQSSGQENTVKNSTHVPKENFRKHPQPRSFDLKTYKPMGFESSFLKFIQESEEKEDDFDDWEPSEHLTLSSSSQPSNDLTGSVMANNMVNDNDPEVDIPHSSSDSAIHENLTAIPPLIVAETAAVPSLENLRVVLDKALTDCGELALKQLHYLRPVVVLERSKFSTPILDLFPTKKTDELCVGSS

SEQ ID NO: 61 - protein, 504 aa, Rattus norvegicus
MAADSDDGVPSVPTPSDGGVNRTTQSAEEFVVRVPVVDVQSDNFKEIWPSLLLALKTASFVAVDTELSGLGDRKSLLNQCIEERYKAVCHAARTRSVLSLGLACFKQQPDKGDSSYLAQVFNLTLLCMEEYVIEPKSVQFLVQHGFNFNRQYAQGIPYHKGNDKGDESQSQSVRTLFLELIRARRPLVLHNGLIDLVFLYQNFYAHLPENLGTFTADLCEMFPAGIYDTKYAAEFHARFVASYLEYAFRKCERENGKQRAAGSPHVALEFCSYPSSMRGHIDYRCCMSPVSCRHSHTTGICDKFSAYGWCPLGPQCPQSHDIDLIIDTDEAVAEDKRRRRRRKDKRKRALQSQPETQTLEEAEDGPPTKQVCEDSLKTEKIEQKVAEGDQLGSTQGHKDSLEMACKRTADVPTSELLVNQASPNPVPGDGLHRAGFDAFMTGYVMAYVGLSKGLQLCSSEPWLPECHNKVYLSGKTVPLTVAKSQFSRPSKAHNQKMKLAWGSS

SEQ ID NO: 62 - protein, 1272 aa, Canis familiaris
MTLNSYLSIVTLNVNGLNDPIKRRRVSDWIKKQDPSICCLQETHFRQMDTYSLKMKDWRTIYHSNGPQKKAGVAILISDKLKFTPKTVVRDEEGHYIILKGSIQQEDLTILNIYAPNVGTAKYINQLLTKVKKYLDNNTLILGDFNLALSILDRSSKHNISKETRALNDTLDQMDFTDIYRTLHPNSTEYTFFSSAHGTFSRIDHILGHKSGLNRYQKIGIVPCIFSDHNALKLELNHNKKFGRTSNTWRLRTILLKDERVNQEIKEELKTFMETNENEDTTIQNLWDAAKAVLRDACNTSIHSKLERTQIQKLTLHIKELEKKQQIDPTPKRRRELIKIRAELKEIETRRTVEQINRTRSWFFERINKIDKPLASLIKKKREKTQINKIMNEKGEITTNTKEIQTILKTYYEQLYANKLGNLEEMDTFLESHKLPKLEQEEIENLNRPITREKIEAVIKNLPRHKSPGPDGFPGEFYQTFKEETIPILLKLFGKIERDGILPNSFYEASITLIPKPDKDPTKKENYRPISLMNMDAKILNKILANRIQQYIKKIIHHDQVGFIPGTQGWFNTRKTVNVIHHISKRKTKNHMILSLDAEKAFDKIQHPFLIKTLQSVGIEGTFLDILKAIYEKPTANIILNGEALGTFPLRSGTRQGCPFSPLLFNIVLEVLASAIRQQKDIKGIQIGKEEVKLSLFADDMILYIENPKVSTPRLLELIQQFGSVAGYKINAQKSMAFLYTNNETEKREFKESSPFTIAPKSIRYLGINLTKDVKDLYPQNYRTLLKEIEEDTKRWKNIPCSWIGRINIVKMSMLPRAIYMFNAIPIKIPWTFFRELEQIILRFVWNQKRPRIARGILQKKTISGGITMPDFRLYYKAVVIKTVWYWHKNRRIDQWNRIENPEVDPELYGQLIFNKGGKTIHWKKDSLFNKWCWENWTSTCRRMKLDHSLAPYTKINSKWMKDLNVRQGSIKILEKNTGNTLFELGHSNFLQDTSTKAKETKAKMNYWDFIKIRSFCTAKDTVNKTQRQPTEWEKIFANDISDQGLVSKIYKELIKLNTKETNNPIMKWAKDMNRNLTEEDVDMANMHMRKCSASLAIREIQIKTTMRYHLTPVRMGKINKAGNNKCWRGCGEKGTLLHCWWECELVQPLWKTVWRFLKQLKIYLPYDPAIALLGIYPKDTNAMKRRDTCTPMFLAAMATIAKLWKEPRCPTKDEWIKKMWFMYTMEYYSAIRNDKYPPFASTWMELEGIMLSEVSQSEKDKHYMFSFIWGI

SEQ ID NO: 63 - protein, 2348 aa, Gallus gallus
MSGTVSAAAGLRPLLETLQDPAAPAGDLTDAHLSLVNWEAQVRALAPRGAARCCTGADEEPPQGRAEARVGLSGCIFGWLRLTSRNRGVVGLEGTLRPPSTASGTSGDARPQLWAGPGPPHLWVSVRTVATKVVRWQSVNKQRASEVEDLLSTLNSIAVKTSDKNTRTRALWVISKQTFPSEIIKKEAPAQMGEEAVRWAKLIIPLVVHSAHKVQLRGATALEIGMPLLLQKQQEVAAVTEHLMTTKLISELQKLFSTKNETYVLKLWPLFVKLLGKTLHRSGSFINSLLQLEELGFRSGSPVVKKIAFIAWKSLIDNFALNPDILCSAKRLKLLMQPLSSIHVRTEALALTKLEVWWYLLMRLGPQLPANFEQVCIPLIQSTLSVDSAAALQGTPSRVPSNPNSANPPQKPGPYPFASPATPRMNLNSSTAGLVAIPSIQLLGIEMLLHFLMGPEVLEFAKRNKLVLSLEPLQHPLISSPSFFCKHASTFINAVQDGFIAVGKEVPESMLNSIWKDINGHVKAAIESGNKKEKQGSEVLTMLLQALKNIVRSNSLPVQKILSLIDITVKELPPKVLGSPAYQIADMDLLNGTPALFLVQLPFHNNLLEWCVTDERFFIILETLMRYVLSGPTSLLAFSESVLCVINQNAKQVENKEHLWRMWSIVVNPLTDWINRTNEVNQGDALEHNFNAVYNALLLPVSHIFPVQEFPQPTMKSLLRAWSDLYRAFARCAALVATAEENLCCEELCAKIISGLEGETPVMSAMLDGLTHVVAVMVDCINFAPYGTKYQPKNRSPQTPTDWSKKKREPLGKLSSLFKLLVMLLDSFHALSSEETCPEPLASVGHSLIAVLHNIISHVSLPSMIGTMFAVFSKPLAVFYEKTKLADVPKAYSNLNSKLEKLLAEIILCLQSHCMGCYDSELLEQLSPLLCVIFQHKSKQMRKQCANFWNTTFAKAASLTYPEELKPVLSQAKQKMPLLLPGFESIEIADEQSGPFSDEAENSQWDAKLSGMEVNLGQKRDSILAQTGELKNEVKDKSDNVQVTSAKLKLEFSASKPKSDVLLEEEKSVDFVFIPPETKARILTEHQKEVLRSKRVGIPAMYNNLDSSQDTTLFSQYTQSQEDSLEKSPLENAKEDFKNNPQQNQNLLFLVQEENGKSESCIADSDGNTGDCKVDNPLEDVKEKSAYHIEKNSNSEEESSRGDRTGIIGEESSVGEALEKSGTETASKESLVGNENTSAISCSSTSSDVICGTPQPASRRQSFITLEKFDSSESRPFSPSALNSVSEVSQSAPVPDKQGNINVCKTGRKPGKSGEESRKSSQSEQISAAKRRLTRRQSKMEQQGNQQAKLVTNSEQEKGAQESFVSNSVENSPESPCSMEDTERVLTAQPQPVSSPEPDIKKAEAVMAEIEKVRAFEMDSKENTPPKTAVSSEQVMGDGSQGPHASLSQKTLRRSSRRRSENAEMAAGSQDKEDGYQKKDKRKEDEKALQKKVPQTKEDASQKQKAVCGKASEHAIKKESSLPERSAAEDLGSKEPPAAKGADEEANRSAGKPEDTLKSDSEGQDCSSDTVSEKKRERPRYHTRRSSQGLLSSIENAEADGSETKKESLKKKSGKTKNKSDSLEGKRKDVQPESQSHGVSSQVDESKNLSGMNESELSSEVSTDAALMSAPSDVKNQVLLAGADEAEGSASSRTSPSTQNVSVEQSKAGVLPESFSDPRVSDEVLKGDENKCIEKQSSVEQHSSVQPENVQGANTSGSDLSSLQMQDCQHKRSKRVRKAKSCDCCSKRVKQQTSLSESKSEDPRELIEPQATPVQMAVSTAEVSGSSNLEESLSITPCAMSTPLPPAKESGMLSLERERTGEDNLQGNSGVMKEEAENPAHTAGEVSDPVVEIKVKEEVDGNDRAEQCVSVSECASDEPSDSSVAAGDQSEEKAAVEKEEESQHGEMEEVPEADGSKPETKQMDELEGNRDGKEEAENALEEVCITPDNEMREELLEAEITVPENVAVGNKDVVVENKSADSPQKPEGLDSFTSVNGSPSGVQARCTWSPSASPSTSILKRGVKRHHEDDSLSPANKIRRVSFANPIYQEGLADDIDRRSPVIRSHSSPSSRSLKILSNIQTKHITTPTKGFLSPGSRNPKFKSSKKCLMTEMVKESLPSPTECVYPALAGCKAPVDVILPQITSNICARGLGQLIRAKNIKTVGDLSALTASEIKTLPIRSPKVSNVKKALRGYHEQQVKSRGCEEIGALEDGERTVNSAEDKSPPVDEEKLATDLGEAIALSSSSPPPADLLSQMDLLAAQLTSEDLRSYPGSRLFEMQEKLASMSDCIMKTLRSRWRSPPHDSAE

SEQ ID NO: 64 - protein, 979 aa, Homo sapiens
MATQAYTELQAAPPPSQPPQAPPQAQPQPPPPPPPAAPQPPQPPTAAATPQPQYVTELQSPQPQAQPPGGQKQYVTELPAVPAPSQPTGAPTPSPAPQQYIVVTVSEGAMRASETVSEASPGSTASQTGVPTQVVQQVQGTQQRLLVQTSVQAKPGHVSPLQLTNIQVPQQALPTQRLVVQSAAPGSKGGQVSLTVHGTQQVHSPPEQSPVQANSSSSKTAGAPTGTVPQQLQVHGVQQSVPVTQERSVVQATPQAPKPGPVQPLTVQGLQPVHVAQEVQQLQQVPVPHVYSSQVQYVEGGDASYTASAIRSSTYSYPETPLYTQTASTSYYEAAGTATQVSTPATSQAVASSGSMPMYVSGSQVVASSASTGAGASNSSGGGGSGGGGGGGGGGGGGGSGSTGGGGSGAGTYVIQGGYMLGSASQSYSHTTRASPATVQWLLDNYETAEGVSLPRSTLYCHYLLHCQEQKLEPVNAASFGKLIRSVFMGLRTRRLGTRGNSKYHYYGLRIKASSPLLRLMEDQQHMAMRGQPFSQKQRLKPIQKMEGMTNGVAVGQQPSTGLSDISAQVQQYQQFLDASRSLPDFTELDLQGKVLPEGVGPGDIKAFQVLYREHCEAIVDVMVNLQFTLVETLWKTFWRYNLSQPSEAPPLAVHDEAEKRLPKAILVLLSKFEPVLQWTKHCDNVLYQGLVEILIPDVLRPIPSALTQAIRNFAKSLESWLTHAMVNIPEEMLRVKVAAAGAFAQTLRRYTSLNHLAQAARAVLQNTAQINQMLSDLNRVDFANVQEQASWVCRCEDRVVQRLEQDFKVTLQQQNSLEQWAAWLDGVVSQVLKPYQGSAGFPKAAKLFLLKWSFYSSMVIRDLTLRSAASFGSFHLIRLLYDEYMYYLIEHRVAQAKGETPIAVMGEFANLATSLNPLDPDKDEEEEEEEESEDELPQDISLAAGGESPALGPETLEPPAKLARTDARGLFVQALPSS

SEQ ID NO: 65 - protein, 910 aa, Canis familiaris
MDTYGVGCVALGEAGPVGNMTVVDSPGQEVLNQLDVKASSETTSAEASIEMSLPTPLTGFEDSLDERRLPQEQESLSRLEQQDLSSEMSKVSKPRASKPGRKRGGSTRKGPKRPQQPNPPSAPLVPGLLDQSNPLSTPMPKKRGRRSKAELLLLKLSKDLEHPESPPPKRPPEDFETPPGERPRRRAAQVALLYLQELAEELSTALPAPVSCPESPKVSSPAKPKKTRQQAACQGGEEEDDTARDEDFVLQVEAEDGDESEAPSESSSDPEPVVPQSTPRGSTSAKQKPHCRGMSPNGLPNHIMAPVWKCLHLTKDLREQKHSYWEFAEWIPLAWKWHLLSELEAAPYLPQEEKSPLFSVQREGIPEDGTLYRINRFSSITAHPERWDVSFFTGGPLWALDWCPVPEGAAASQYVALFSSPDMNETHPLSQLHSGPGLLQVWGLGTLQQESCPGNRAHFVYGIACDHGCIWDLKFCPSGAWELPGTPRKAPLLPRLGLLALACSDGKVLLFSLPHPEALLAQQPPEAMKPAIYKVQCVATLQVGSMQASDPSECGQCLSLAWMPTRPHHHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFPIYKADLMPYQDSPEGRDHSASSEAPNPPKARTYAETVNHHYLLFQDTDLSSFHDLLHREPMLRMQEGEGHSQLCLDRLQLEAIHKVRFSPNLDSYGWLVSGGQSGLVRIHFVRGLTSPLGHRMQLESRAHFSAMFQPSSPIKGPGFPPTSHRLLPGP

SEQ ID NO: 66 - protein, 406 aa, Xenopus tropicalis
MPGHLQEGFGCVVTNRFDQLFDDESDPFEVLKAAENKKKEGAGGPGQGTGKTAAQAAKQPKKESQKDRKNPLSEKEEKSQAPVPIKKEAIRRVGRRPDQQQQPPQQPPTQQQQQQQQQQQQQQQPPQSSQGEGKPVDRRQSDRRPPRERRFEKPTEEKGEAGEFSVDRPIVDRPIRGRGGPGGRGGRGGRGRGLGRGDGFDSRGKREFDRHSGSDRASSHFSGPKHEDKRGGSGSHNWGTVKDELSELDQSAVTEETPETEEHPAVDSENKENEAEEVKEEGPKEMTLDEWKAMQDKERSKVEFNIRKPNEGADGQWKKGFVLHKAKSDEVHAESDALDHHFRKPANDITSQLEINFGDLGRPGRGGRGGRGGRARGGRPSRGGRTDKSNASAPDVDDPEAFPALA

SEQ ID NO: 67 - protein, 385 aa, Gallus gallus
MKPRSFMGCRIKTFRRRELPVRTERCAMEPPGTAGAPGAAGRPWDEAKAFYDNLTPKKKPKSPKPENAITIAVSSRALFRMEEEQKIYNEQGVEAYVKYQLDHENEPFLPGAAFPFVKALEAVNTQLRELYPDSEELFDIVLMTNNHAQVGVRLINSINHYDLFIERFCMTGGNSPIGYLKAYHTNLYLSSDAEKVSGAIEEGIAAATIFSPSKDLEVSEKQLRVAFDGDAVLFSDESEQIVKAHGLDMFFEHEKAHENNPLAQGPLKGFLEALGKLQKKFYSKGLRMECPIRTYLVTARSAASSGARALKTLRSWGLETDEALFLAGAPKGPLLKKIRPHIFFDDQMFHVEGAKEMGTVAAHVPYGVAQKHKRPLQEKQPQNSK

SEQ ID NO: 68 - protein, 463 aa, Xenopus laevis
MLLTLKNTGQLLVAACSKVARSLAKYHPRVNHHRHCVWCSKRGLTTGGTAQKQDILFHLCQQRHFLSGETLTCTSLVQGCHNLGPLGVELKRNLVAQWWNSVVVYREQVLGIDTLHHLSTPSSAPEKPLLAICTQHLKELPRDQLVKWLEDPAGKLEFLRHELLYGALLEYVPSMELLNKKMPFGLAEIGKCFHSIPEERNKGTILPRIGERTVASLVWFSSPKSSGQWQDYWLRQRLQWWQKFAQSPSGFSCNDIQDGQGRKSSLIQYEFPWGRETIETLCNMDDSALFQMHPGCTTKLQARDGRKSVVPHVVWVSGDLDRGILAYLSDALQQTEAPAVRGQYHQREVLKLHPTLAPIKVAVDMGKGPTGELRLVCQGLSSELREQGVYVWPGYQETLHGSLEQLYTKYDKMGVLFTVLVSESTLENGLLQVRSRDTTLKETIHVSKVKDFLVRYIAAAGNL

SEQ ID NO: 69 - protein, 608 aa, Mus musculus
MAAAAATAVGPGAGSAGVAGPGGAGPCATVSVFPGARLLTIGDANGEIQRHAEQQALRLEVRAGPDAAGIALYSHEDVCVFKCSVSRETECSRVGRQSFIITLGCNSVLIQFATPHDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGVAVAGMPTAYDLSSVIAGGSSVGHNNLIPLANTGIVNHTHSRMGSIMSTGIVQGSSGAQGGGGSSSAHYAVNNQFTMGGPAISMASPMSIPTNTMHYGS

SEQ ID NO: 70 - protein, 1740 aa, Homo sapiens
MGRSQGSPMDPMVMKRPQLYGMGSNPHSQPQQSSPYPGGSYGPPGPQRYPIGIQGRTPGAMAGMQYPQQQDSGDATWKETFWLMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAASASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMPPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLANDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 71 - protein, 393 aa, Xenopus laevis
MYSMMMETDLHSPGVQPPNNTGQGGGNKASQDRVKRPMNAFMVWSRGQRRKMAQENPKMHNSEISKRLGAEWKVMSEAEKRPFIDEAKRLRALHMKEHPDYKYRPRRKTKTLLKKDKYSLAGGLLHAAGGGHMGVGLSPGGGGGGCGGAGGMVVQRMESPGSGASTGGYAHMNGWANGAYPGSVAAAAAAAMMQEAQLAYSQQQQQHPGSGGHHPHHHPHHPHHHPHHHPHHNPTSHPTPPQPMHRYDMSALQYSPLPGAQTYMSASPSSYGALSYSSSQQQHQGSPSSAAVAAAAAAASSGALGVLGSLVKSEPSVSPPVSGGGSHNRPPCPGDLREMISMYLPGGGEAGDPAAAAAAAAAAAAATSRLHSLPQHYQGTGTGITSTMPLTHI

SEQ ID NO: 72 - protein, 252 aa, Canis familiaris
MPLLPSTVGLAGLLFWGGQTVNALMPNATLALAQTEGTAVWPLSGLGVPRYRRKRHISAGDMSALLDYHNHIRASVHPPAANMEYMVWDERLARSAEAWATQCIWAHGPSQLMRYVGQNLSIHSGRYRSVVDLVKSWSEERRHYSFPAPRDCQPHCPWRCSGPVCSHYTQMVWASSNRLGCAIHTCGSINVWGNTWHQAVYLVCNYAIKGNWIGEAPYKMGRPCSACPPSYQGTCSSNMCFSGLKSNRLLWF

SEQ ID NO: 73 - protein, 928 aa, Homo sapiens
MAKVPKLEDTFLQAQPAPQLSPGIQEDCCVQLLGKGLLVYPEETVYLAAEGQPGGEQGGGEKGEDPELPGAVKSEMHLNNGNFSSEEEDADNHDSKTKAADQYLSQKKTITQIVKDKKKQTQLTLQWLEENYIVCEGVCLPRCILYAHYLDFCRKEKLEPACAATFGKTIRQKFPLLTTRRLGTRGHSKYHYYGIGIKESSAYYHSVYSGKGLTRFSGSKLKNEGGFTRKYSLSSKTGTLLPEFPSAQHLVYQGCISKDKVDTLIMMYKTHCQCILDNAINGNFEEIQHFLLHFWQGMPDHLLPLLENPVIIDIFCVCDSILYKVLTDVLIPATMQEMPESLLADIRNFAKNWEQWVVSSLENLPEALTDKKIPIVRRFVSSLKRQTSFLHLAQIARPALFDQHVVNSMVSDIERVDLNSIGSQALLTISGSTDTESGIYTEHDSITVFQELKDLLKKNATVEAFIEWLDTVVEQRVIKTSKQNGRSLKKRAQDFLLKWSFFGARVMHNLTLNNASSFGSFHLIRMLLDEYILLAMETQFNNDKEQELQNLLDKYMKNSDASKAAFTASPSSCFLANRNKGSMVSSDAVKNESHVETTYLPLPSSQPGGLGPALHQFPAGNTDNMPLTGQMELSQIAGHLMTPPISPAMASRGSVINQGPMAGRPPSVGPVLSAPSHCSTYPEPIYPALPQANHDFYSTSSNYQTVFRAQPHSTSGLYPHHTEHGRCMAWTEQQLSRDFFSGSCAGSPYNSRPPSSYGPSLQAQDSHNMQFLNTGSFNFLSNTGAASCQGATLPPNSPNGYYGSNINYPESHRLGSMVNQHVSVISSIRSLPPYSDIHDPLNILDDSGRKQTSSFYTDTSSPVACRTPVLASSLQTPIPSSSSQCMYGTSNQYPAQETLDSHGTSSREMVSSLPPINTVFMGTAAGGT

SEQ ID NO: 74 - protein, 148 aa, Acidovorax sp. JS42
MKIDVKILDPRMADQLPTYATPGSAGLDLRACLEAPLTLEPNAWQLVPTGIAIYLQDPGYAALILPRSGLGHKHGIVLGNLVGLIDSDYQGQLMVSAWNRSPQAFTLQPMERLAQLVIVPVVQAQFNVVQEFPASERGEGGYGSTGKH

SEQ ID NO: 75 - protein, 165 aa, Acidovorax avenae subsp. citrulli AAC00-1
MPTTLQAQSPVAAAKKDPKLANNWKTKPAEELSDAEVLSMPDSEYMNEKQLAFFRHKLVQLKQDMHNNAGETTEHLREDTVVVPDPADRATIEEEHALELRTRDRERKLLKKIEQSIARIDAGDYGYCDETGEPIGVGRLLARPTATLSLEAQQRRELKQKMFGD

SEQ ID NO: 76 - protein, 225 aa, Xenopus tropicalis
MADHMMAMNHSRFQDGTNGLHHPAHRMGMGQFSNHHHHPQQHTFNSLMGEHMHYGPGNINANNSIRHAIVTGNVNGGHPNGSMAPASRFNSPFMGPVPNQGAQLTASMQLQKLNNQYFTHHPYPHNHYIPELHPANQINGTNQHFRDCNPKHSTGMPPSVSHVPAAMLPPSVIDTDFIDEEVLMSLVIEMGLDRIKELPELWLGQNEFDFMTDFVCKQQPNRVSC

SEQ ID NO: 77 - protein, 535 aa, Xenopus tropicalis
SAVMKNYRQREKQGNKAQESAKAPDEAKIKALLERTGYTLDVTTGQRKYGGPPPESVSSGAQPGIGTEVFVGKIPRDLFEDELVPLFEKAGPIWDLRLMMDPLSGQNRGYAFITFCNKEAAQEAVKLCDNYEIRPGKHIGVCISVANNRLFVGSIPKNKTKENILEEFSKVTEGLVDVILYHQPDDKKKNRGFCFLEYEDHKTAAQARRRLMSGKVKVWGNVVTVEWADPVEEPDPEIMAKVKVLFVRNLSSTVTEEILEKAFSVFGKLERVKKLKDYAFVHFDERDAAVRAMDEMNGTELEGEEIEIVLAKPPDKKRKERQAARQASRGSSYDDYYYYPPPRMPPPGRGRGRGGRGGYSFPQDYYGYEDYYDDYYAYDYHDYRGGYDDPYYGYDDGYPVRGRGGRGGRGGPPPPRGRSVPPQRGGRSSYAPRGSPMGPPRGSRGGRGGPAQQQPRGRNSRGSRGSRGGNVGGKRKADGYTQPDSKRRQTNNQQNWGTQPIAQQPLQQGGDYTGNYGYSNDNQEFYQDTYGQQWK

SEQ ID NO: 78 - protein, 257 aa, Xenopus tropicalis
GNLLVIIIIAATTHFHSVTSIFLINLAVSDFLVGIGVMPLVATSVIYNRWINHQFLCLYMGYASVVYCTSSVLTLAAIAVDRYRAIVNCFRYNSQTTMKRAVSTVMWIWAQAAFSGLPPFLGWGHFEYFPITFSCSANWAYSPSYTGLVMVCSFLLPTCTMVFCYISIVQVIRDHARRIHNIEWREHNGTIRLFLVIFIFFFCWVPYIIVSMLQPITTKRNQWKLPPELLTASAWLALLNSAINPLLYALLSKRFRK

SEQ ID NO: 79 - protein, 2589 aa, Xenopus tropicalis
QLPSLKALSYSPMSSASIPCEHPILPSFSESTPQDFHSVTLLDTTSHLLDDNVLYPDSGQEECLAVEATSINGMENSGGGGTGVKKKRKKKEPGEEKVAKPKKKKEPKKVKEPKKVKEPSEAKDPKEQKQPKSPKEPKKPRKPREPKPPKQKKANQDSAAKTKPKKLSKEQGPTPLEKKKKGKRKAEFSEESLDGEPSLLNPASQSTEESTESLDSQKRRSGRQVKRRKYNEDLDFKVVDDDGETIAVLGAGRASALSASTLAWQAEEPPEDDANIIERILSSRISQKEFVHAGIPLEVEEFYVKYRNFSYLHCKWATLEELEKDPRIQQKIKRFRNKQAQMKHIFTEPDEDMFNPDYVEVDRVLEVAHTKDSDTGEEVTHFLVKWCSLPYEESTWELEEDVDPVKVKEFEALQKVPDLTPMERPASETWQKLVSSRTYKNNNQLREYQLEGMNWLLFNWYNRKNCILADEMGLGKTIQSITFLSEIFFMGIRGPFLIIAPLSTITNWEREFRTWTEMNTIVYHGSQISRQMIHQYEMYYRDEQGTPIPGIYKFQIVITTFEMILADCPELKKIRWSCVIIDEAHRLKNRNCKLLEGLKLMALEHKVLLTGTPLQNSVEELYSLLNFLEPVQFPSESTFLEEFGDLKTEEQVRKFYWLFDFLWMLEIRDNVPCSVTEGFCAHIKAQGCRLSYTGISEYHSCIIRGNVPPTVNDKDIRITIYLAGGGLFGPLGTWNARAYFEHQSGPDLGKLYTMQPILLILGGFYCLSAKINWWPLCRYIYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGNTNGVQPLSKIEVEDLLRKGAYGALMDEEDEGSKFCEEDIDQILQRRTQTITIQSEGKGSTFAKASFVSSGNRTDISLDDPNFWQKWAKIAELDTDARNEKESLVLDRPRVRKQTKHYNSFEDDELMEFSELESDTEERPTRSRRLNDKTRRYLRAECFRVEKNLLIFGWGRWKDILNLGRFKWHLNEKDMEMICRALLVYCVKHYKGDEKIKSFIWDLITPTKDGHNQALQNHSGLSAPVPRGRKGKKLKNQMLLPEIKNADWLASCNPEIVLHDDSYKKHLKQHCNKVLLRVRMLYYLKAEVLGEAASRALEGENARDLEVLLPDIDYVEIPVDWWDTEADKSLLLGVYKHGYERYFAMRADPALCFLDKVGMPDETSLTADGVNDVAPELGDGAIKEENNEEKVNEQQEVSEQIYFTQFDASESTGKEEKADEESTQDSPEADKLSWPVASALTARLRRLITVYQRCNRRDLARPEVLVPTNHSYWLQEEMARRAEMDPIMKEMQKRWTRREQADFYRTVSSFGVIYDPEKKCFDWTQFRALSRLDKKTDESLEKYFHSFVAMCRNVCRLPLRKDDGSADPSLFLDPITEERAARTLYRIELLRKVREQVLRHPQLHDRLKLCRPSLYLPVWWECGKHDRDLLIGTAKHGLSRTDYYIMNDPQLSFLDAYRNYAQNKRNSGENMCYHFQMNSKVQETPSCHLERTCESTKLKPEKDIKTEVEEATTSNQMCSPPDLTCENFISQVGDMISNNHDECSMSDSLMCMICDEKTCNSALLDASNSEQSSLTQESFLGLEAKNGPTDYSLNKAKEDNILPVEESVSRDCFLGSSEKDEPMEGIDRINEPFGDSGSHLGLAAEDCEKAQVDAIGQRDLDDDNFCTSLSQTAEQSLGLDLEFLDKTFGDHSALSPGINEDKDCGITGEHSEGPHLNPMPVQEKEEWGADLQELKEDPIVKWQNELNDMKDPPLEDVIKDHKLEDLSIEKDSSTSKGSYGIPSLQVNECLDMKHKTSLMLSGLLKQKVEDLKERIAGENVLEESNVPLEENETIKLEECEVKKEVKKESVEEECNCKDYLDKYTEDDVKACPLSVPEESHQDFQDGRAPTIAQLLQEKTLYSFSEWPKDRVIINRIDNICHAVLKGKWPSSSQQFEAQCMVPSSVLSTCTRSSSYPAEAQSIAYSNGSPVPQAQKEPLSAATFPNEERKHRRPFEFDSERQDGKLRGLEHLSPSHGRTNSALNGWRDAAIELCREQAAGGGSSYPMNTSTPKIAGIGGLQSSLGMDLSGILQAGLIHPVTGQIVNGSLRRDESSLRRRRGRRKNVEGMDLGFLKDRGMHAGILGLREVPNQLGSGHTESSLSASARSGVPGAKFQPEKVISNKSLLEWLRQQSDCTIDIPTYGGSFSDKPKPRRQRCKEPSKPEFSLLAGDDRVSLVNKDTGQQGFLPESKFGRALPEPLMHETMPRRRGRRPRSELLKSTGTMGSDSSSGMGPLFMNGLIAGMDIVGLQNMRNMQGIPLTGLVGFPAGFTAVSTNEEMKSTLSMLPMMLPGMAAMPQMFGVGGIINSPMATSVPTSLGSTIKSGSSHPDKATEDKDACPETKPDTAPSDKPSGSFQEKSEPAVTTSSPVAFNPFLIPGMSPSLLYPSMFLSPGIGMAIPGVQPNRLSESGGIDHQRRRRKKTKGETQTSEQETVPFTE

SEQ ID NO: 80 - protein, 843 aa, Xenopus tropicalis
NWPTPSEIANHGTQNVLCAAANGKAASKQEKSSDGKTDHKDVCETKENCNMEVQVKNPKPNDQVEATAQKKKFNKQKWMPLHIEETKTVKQESPTIHKNSSSQCEVSRNQNSKQRDYSWRLDRRRELDEVSSVHSEGGNIRGSLRGSGRGRGRGRGRPYMHYSYSARENRMRTDHIENYKSMMYYYDDGTGMHVYPVDKKLLKEYLKRQIEYYFSTENLEKDFFLRRKMDLQGFLPLSLIAGFYRVQSLTTDVDLMCEALKDSVEVEIVDQKIRRKVDPEKWPIPSAPSLDLTRTDFSRFIDCPEFIPGKKLESHTGSVPNSPRKECSFLQDGSNKLNNLQSMPKVLSSSMPELDSEPWIEVKKRRRPSPIKSKPDIPTQITSKPQLCDEPDPEDLDFMFDEELQHMQGRKNTFTDWSDDDSDYEIDDKDLNKIIIVTQTPPHLKKHPGGDRTGNHISRAKMTSELAKVINDGLYYYEKDLWMDCEEQNYVPSKQELEHFRKLNLISKEEFDNLAPEFQIEQNLEQSPLNIPTFQQAVFLPVCCEDFHGPATTQFHPTDVQQSPMSCHARTPKSPRTPRLKDPSKTPRFYPVVKEARSIDVQSPRKRKTRHSTNPPLEYHVGWVMDSKEHRPRTSSVSSSNASPSEVAPLTGSYGCTPHSLPKFQHPSHELLKENGFTQQVYHKYRRRCLNERKKLGVGQSPEMNTLYRFWSFFLRDHFNKKMYEEFRQLAVEEAKENYRYGLECLFRFYSYGLERKFRQELFEDFQEETVKDYEHGNLYGLEKFWAYLKYSKAKNLSVDPKLQSYLSKFKRLEDFRVDPPIAEENGRMTSASNEDPGRRRHR

SEQ ID NO: 81 - protein, 423 aa, Homo sapiens [sequence omitted]

SEQ ID NO: 82 - protein, 2220 aa, Homo sapiens
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 83 - protein, 651 aa, Homo sapiens
MLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWEEEGTYDQTLEFRRGGDGQPRRSTRPTQQFYQPPRARN

SEQ ID NO: 84 - protein, 1143 aa, Homo sapiens
MNSDQVTLVGQVFESYVSEYHKNDILLILKERDEDAHYPVVVNAMTLFETNMEIGEYFNMFPSEVLTIFDSALRRSALTILQSLSQPEAVSMKQNLHARISGLPVCPELVREHIPKTKDVGHFLSVTGTVIRTSLVKVLEFERDYMCNKCKHVFVIKADFEQYYTFCRPSSCPSLESCDSSKFTCLSGLSSSPTRCRDYQEIKIQEQVQRLSVGSIPRSMKVILEDDLVDSCKSGDDLTIYGIVMQRWKPFQQDVRCEVEIVLKANYIQVNNEQSSGIIMDEEVQKEFEDFWEYYKSDPFAGRNVILASLCPQVFGMYLVKLAVAMVLAGGIQRTDATGTRVRGESHLLLVGDPGTGKSQFLKYAAKITPRSVLTTGIGSTSAGLTVTAVKDSGEWNLEAGALVLADAGLCCIDEFNSLKEHDRTSIHEAMEQQTISVAKAGLVCKLNTRTTILAATNPKGQYDPQESVSVNIALGSPLLSRFDLILVLLDTKNEDWDRIISSFILENKGYPSKSEKLWSMEKMKTYFCLIRNLQPTLSDVGNQVLLRYYQMQRQSDCRNAARTTIRLLESLIRLAEAHARLMFRDTVTLEDAITVVSVMESSMQGGALLGGVNALHTSFPENPGEQYQRQCELILEKLELQSLLSEELRRLERLQNQSVHQSQPRVLEVETTPGSLRNGPGEESNFRTSSQQEINYSTHIFSPGGSPEGSPVLDPPPHLEPNRSTSRKHSAQHKNNRDDSLDWFDFMATHQSEPKNTVVVSPHPKTSGENMASKISNSTSQGKEKSEPGQRSKVDIGLLPSPGETGVPWRADNVESNKKKRLALDSEAAVSADKPDSVLTHHVPRNLQKLCKERAQKLCRNSTRVPAQCTVPSHPQSTPVHSPDRRLDSPKRKRPKSLAQVEEPAIENVKPPGSPVAKLAKFTFKQKSKLIHSFEDHSHVSPGATKIAVHSPKISQRRTRRDAALPVKRPGKLTSTPGNQISSQPQGETKEVSQQPPEKHGPREKVMCAPEKRIIQPELELGNETGCAHLTCEGDKKEEVSGSNKSGKVHACTLARLANFCFTPPSESKSKSPPPERKNRGERGPSSPPTTTAPMRVSKRKSFQLRGSTEKLIVSKESLFTLPELGDEAFDCDWDEEMRKKS

SEQ ID NO: 85 - protein, 634 aa, Homo sapiens
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 86 - protein, 2629 aa, Rattus norvegicus
MEKLCGYVPVHPDILSLKNRCLTMLSDIQPLEKIHGQRSVNPDILSLENRCLTLLPDLQPMEKIHGQRSVHPDILSSENRCLTLLPDLQSLEKLCGHMSSHPDVLSLENRCLATLPTVKRTVSSGPLLQCLHRSHTAQADLRDPNFRNCLFPEPPTIEAPCFLKELDLPTGPRALKSMSATARVQEVALGQRCVSEGKELQEEKESAEVPMPLYSLSLGGEEEEVVGAPVLKLTSGDSDSHPETTDQILQEKKMALLTLLCSAMASSVNVKDASDPTRASIHEVCSALAPLEPEFILKASLYARQQLNLRDIANIVLAVAALLPACRPHVRRYYSAIVHLPSDWIQVAEFYQSLAEGDEKKLVPLPACLRAAMTDKFAQFDEYQLAKYNPRKHRSKTRSRQPPRPQRTKPPFSESGKCFPKSVWPLKNEQISFEAAYNAVSEKKRLPRFTLKKLVEQLHIHEPAQHVQALLGYRYPSTLELFSRSHLPGPWDSSRAGQRMKLQRPETWERELSLRGNRASVWEELIDNGKLPFMAMLRNLCNLLRTGISAHHHELVLQRLQHEKSVIHSRQFPFRFLNAHDSLDRLEAQLRSKASPFPSNTTLMKRIMIRNSKKIKRPANPRYLCTLTQRQLRAAMAIPVMYEHLKREKLRLHKARQWTCDLELLERYRQALETAVNISVKHNLPPLPGRTLLVYLTDANANRLCPKSHLQGPPLNYVLLLIGMMMARAEQTTVWLCGTGTVKTPVLTADEGILKTAIKLQAQVQELEENDEWPLETFEKYLLSLAVRRTPIDRVILFGQRMDTELLNVAKQIIWQHVNSKCLFVSVLLRKMQYMSPNLNPNDVTLSGCTDGILKFIAEHGASRLLEHVGQLDKIFKIPPPPGKTKVSPLRPLEENNPGPFVPISQHGWRNIRLFISSTFRDMHGERDLLMRSVLPALQARAFPHRISLHAIDLRWGITEEETRRNRQLEVCLGEVENSQLFVGILGSRYGYTPPSYDLPDHPHFHWTQRYPSGRSVTEMEVMQFLNRGQRSEPSDQALIYFRDPGFLSSVPDVWKPDFISESEEAAHRVSELKRFLQEQKEVTCRRYSCEWGGVAAGRPYTGGLEEFGQLVLQDVWSVIQKRYLQPGAQLEQPGSISEEDLIQASFQQLKSPPSPARPRLLQDTVQQLMLPHGRLSLVIGQAGQGKTAFLASLVSALKVPDQPNVAPFVFFHFSAARPDQCLAFNLLRRLCTHLHQKLGEPSALPSTYRGLVWELQQKLLLKSAQWLQPGQTLVLIIDGADKLVDHNGQLISDWIPKSLPRRVHLVLSVSSDSGLGETLQQSQSAYVVALGSLVPSSRAQLVREELALYGKRLEESPFNNQMRLLLAKQGSSLPLYLHLVTDYLRLFTLYEQVSERLRTLPATLPLLLQHILSTLEQEHGHNVLPQALTALEVTHSGLTVDQLHAVLSTWLTLPKETKSWEEAVAASHSGNLYPLAPFAYLVQSLRSLLGEGPVERPGARLCLSDGPLRTAVKRRYGKRLGLEKTAHVLIAAHLWKMCDPDASGTFRSCPPEALKDLPYHLLQSGNHGLLAKFLTNLHVVAAYLEVGLVPDLLEAYELYASSKPEVNQKLPEADVAVFHNFLKQQASLLTQYPLLLLQQAASQPEESPVCCQAPLLTQRWHNQCILKWINKPQTLKGQQSLSLPISSSPTAVAFSPNGQRAAVGTAGGTIYLLNLRTWQEEKALVSGCDGISSFAFLSDTALFLTTFDGLLELWDLQHGCWVFQTKAHQYQITGCCLSPDRRLLATVCLGGYVKLWDTVQGQLAFQYTHPKSLNCITFHPEGQVVATGNWSGIVTFFQADGLKVTKELGGPGPSVRTLAFSAPGKVVALGRIDGTVELWAWQEGTRLAAFPAQCGGVSTVLFLHAGGRFLTAGEDGKAQLWSGFLGRPRGCLGSLYLSPALSVALNPDGDQVAVGYRGDGIKIYRISSGPQEAQCQELNVAVSALVWLSPSVLVSGAEDGSLHGWMLRRNSLQSLWLSSVCQKPVLGLAASQEFLASASEDFTVRLWPRQLLTQPHAVEELPCAAELRGHEGPVCCCSFSPDGRILATAGRDRNLLCWDVKVAQAPLLIHTFSSCHRDWITGCTWTKDNILISCSSDGSVGLWNPEAGQQLGQFPGHQSAVSAVVAVEEHIVSVSRDGTLKVWDRQGVELTSIPAHSGPISQCAAALEPRPAGQPGSELMVVTVGLDGATKLWHPLLVCQIHTLQGHSGPVTAAAASEASGLLLTSDNSSVRLWQIPKEADDTCKPRSSAVITAVAWAPDGSLVVSGNEAGELTLWQKAQAVATARAPGRVSDLIWCSANAFFVLSANENVSEWQVELRKGSTCTNFRLYLKRVLQEDLGVLTGMALAPDGQSLILMKEDVELLQMKPGSTPSSICRRYAVHSSILCTSKDYGLFYLQQGNSGSLSILEQEESGKFEKTLDFNLNLNNPNGSPVSITQAEPESGSSLLCATSDGMLWNLSECTPEGEWVVDNIWQKKSRNPKSRTPGTDSSPGLFCMDSWVEPTHLKARQCKKIHLGSVTALHVLPGLLVTASEDRDVKLWERPSMQLLGLFRCEGPVSCLEPWMEPSSPLQLAVGDAQGNLYFLSWE

SEQ ID NO: 87 - protein, 483 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 88 - protein, 1419 aa, Homo sapiens
MAEGLERVRISASELRGILATLAPQAGSRENMKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKTSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 89 - protein, 411 aa, Homo sapiens
MNAETCVSYCESPAAAMDAYYSPVSQSREGSSPFRAFPGGDKFGTTFLSAAAKAQGFGDAKSRARYGAGQQDLATPLESGAGARGSFNKFQPQPSTPQPQPPPQPQPQQQQPQPQPPAQPHLYLQRGACKTPPDGSLKLQEGSSGHSAALQVPCYAKESSLGEPELPPDSDTVGMDSSYLSVKEAGVKGPQDRASSDLPSPLEKADSESNKGKKRRNRTTFTSYQLEELEKVFQKTHYPDVYAREQLAMRTDLTEARVQVWFQNRRAKWRKRERFGQMQQVRTHFSTAYELPLLTRAENYAQIQNPSWLGNNGAASPVPACVVPCDPVPACMSPHAHPPGSGASSVTDFLSVSGAGSHVGQTHMGSLFGAASLSPGLNGYELNGEPDRKTSSIAALRMKAKEHSAAISWAT

SEQ ID NO: 90 - protein, 892 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAVNNVHMKHTGTIPGAQGLMNSSLLHQPKARP

SEQ ID NO: 91 - protein, 275 aa, Xenopus tropicalis
MAPALLMATYQPGVKVEESPSVNKMQTGLKVALGEDKPKVPGILPFSVEALMADRKPGRERDLSSPTGSPLAGTSHSPRVGSLAPGETPNSPISIGNRFPVGGIMKLPEEALVKPESPERSSWIQSPRFSPSPTRRMSPPACTLRKHKTNRKPRTPFTTSQLLALERKFRQKQYLSIAERAEFSSSLNLTETQVKIWFQNRRAKAKRLQEAELEKLKMAAKPMLPPAFGISFPLGTPVPTASLYGTSNPFQRPALPVSPMGLYTAHVGYSMYHLS

SEQ ID NO: 92 - protein, 357 aa, Homo sapiens
MIEQQKRKGPELPLVPVKRQRHELLLGAGSGPGAGQQQATPGALLQAGPPRCSSLQAPIMLLSGHEGEVYCCKFHPNGSTLASAGFDRLILLWNVYGDCDNYATLKGHSGAVMELHYNTDGSMLFSASTDKTVAVWDSETGERVKRLKGHTSFVNSCYPARRGPQLVCTGSDDGTVKLWDIRKKAAIQTFQNTYQVLAVTFNDTSDQIISGGIDNDIKVWDLRQNKLTYTMRGHADSVTGLSLSSEGSYLLSNAMDNTVRVWDVRPFAPKERCVKIFQGNVHNFEKNLLRCSWSPDGSKIAAGSADRFVYVWDTTSRRILYKLPGHAGSINEVAFHPDEPIIISASSDKRLYMGEIQ

SEQ ID NO: 93 - protein, 5596 aa, Homo sapiens
MEHFLLEVAAAPLRLIAAKNEKSRSELGRFLAKQVWTPQDRQCVLSTLAQLLLDKDCTVLVGRQLRPLLLDLLERNAEAIKAGGQINHDLHERLCVSMSKLIGNHPDVLPFALRYFKDTSPVFQRLFLESSDANPVRYGRRRMKLRDLMEAAFKFLQQEQSVFRELWDWSVCVPLLRSHDTLVRWYTANCLALVTCMNEEHKLSFLKKIFNSDELIHFRLRLLEEAQLQDLEKALVLANPEVSLWRKQKELQYLQGHLVSSDLSPRVTAVCGVVLPGQLPAPGELGGNRSSSREQELALRSYVLVESVCKSLQTLAMAVASQNAVLLEGPIGCGKTSLVEYLAAVTGRTKPPQLLKVQLGDQTDSKMLLGMYRCTDVPGEFVWQPGTLTQAATMGHWILLEDIDYAPLDVVSVLIPLLENGELLIPGRGDCLKVAPGFQFFATRRLLSCGGNWYRPLNSHATLLDKYWTKIHLDNLDKRELNEVLQSRYPSLLAVVDHLLDIYIQLTGEKHHSWSDSSVGCEQAPEEVSEARRENKRPTLEGRELSLRDLLNWCNRIAHSFDSSSLSASLNIFQEALDCFTAMLSEHTSKLKMAEVIGSKLNISRKKAEFFCQLYKPEIVINELDLQVGRVRLLRKQSEAVHLQREKFTFAATRPSSVLIEQLAVCVSKGEPVLLVGETGTGKTSTIQYLAHITGHRLRVVNMNQQSDTADLLGGYKPVDHKLIWLPLREAFEELFAQTFSKKQNFTFLGHIQTCYRQKRWHDLLRLMQHVHKSAVNKDGKDSETGLLIKEKWEAFGLRLNHAQQQMKMTENTLLFAFVEGTLAQAVKKGEWILLDEINLAAPEILECLSGLLEGSSGSLVLLDRGDTEPLVRHPDFRLFACMNPATDVGKRNLPPGIRNRFTELYVEELESKEDLQVLIVDYLKGLSVNKNTVQGIINFYTALRKESGTKLVDGTGHRPHYSLRTLCRALRFAASNPCGNIQRSLYEGFCLGFLTQLDRASHPIVQKLICQHIVPGNVKSLLKQPIPEPKGGRLIQVEGYWIAVGDKEPTIDETYILTSSVKLNLRDIVRVVSAGTYPVLIQGETSVGKTSLIQWLAAATGNHCVRINNHEHTDIQEYIGCYTSDSSGKLVFKEGVLIDAMRKGYWIILDELNLAPTDVLEALNRLLDDNRELLVTETQEVVKAHPRFMLFATQNPPGLYGGRKVLSRAFRNRFVELHFDELPSSELETILHKRCSLPPSYCSKLVKVMLDLQSYRRSSSVFAGKQGFITLRDLFRWAERYRLAEPTEKEYDWLQHLANDGYMLLAGRVRKQEEIDVIQEVLEKHFKKKLCPQSLFSKENVLKLLGKLSTQISTLECNFGHIVWTEGMRRLAMLVGRALEFGEPVLLVGDTGCGKTTICQVFAALANQKLYSVSCHLHMETSDFLGGLRPVRQKPNDKEEIDTSRLFEWHDGPLVQAMKEDGFFLLDEISLADDSVLERLNSVLEVEKSLVLAEKGSPEDKDSEIELLTAGKKFRILATMNPGGDFGKKELSPALRNRFTEIWCPQSTSREDLIQIISHNLRPGLCLGRIDPKGSDIPEVMLDFIDWLTHQEFGRKCVVSIRDILSWVNFMNKMGEEAALKRPEIISTVTSFVHAACLVYIDGIGSGVTSSGFGTALLARKECLKFLIKRLAKIVRLTEYQKNELKIYDRMKAKEFTGIDNLWGIHPFFIPRGPVLHRNNIADYALSAGTTAMNAQRLLRATKLKKPILLEGSPGVGKTSLVGALAKASGNTLVRINLSEQTDITDLFGADLPVEGGKGGEFAWRDGPLLAALKAGHWVVLDELNLASQSVLEGLNACFDHRGEIYVPELGMSFQVQHEKTKIFGCQNPFRQGGGRKGLPRSFLNRFTQVFVDPLTVIDMEFIASTLFPAIEKNIVKKMVAFNNQIDHEVTVEKKWGQKGGPWEFNLRDLFRWCQLMLVDQSPGCYDPGQHVFLVYGERMRTEEDKKKVIAVFKDVFGSNSNPYMGTRLFRITPYDVQLGYSVLSRGSCVPHPSRHPLLLLHQSFQPLESIMKCVQMSWMVILVGPASVGKTSLVQLLAHLTGHTLKIMAMNSAMDTTELLGGFEQVDLIRPWRRLLEKVEGTVRALLRDSLLISADDAEVVLRAWSHFLLTYKPKCLGEGGKAITMEIVNKLEAVLLLMQRLNNKINSYCKAEFAKLVEEFRSFGVKLTQLASGHSHGTFEWVDSMLVQALKSGDWLLMDNVNFCNPSVLDRLNALLEPGGVLTISERGMIDGSTPTITPNPNFRLFLSMDPVHGDISRAMRNRGLEIYISGEGDASTPDNLDLKVLLHSLGLVGNSVCDILLALHTETRSTVVGSPTSSVSTLIQTAILIVQYLQRGLSLDRAFSEACWEVYVCSQHSPANRKLVQALLEKHVSSLRAHETWGDSILGMGLWPDSVPSALFATEDSHLSTVRRDGQILVYCLNRMSMKTSSWTRSQPFTLQDLEKIMQSPSPENLKFNAVEVNTYWIDEPDVLVMAVKLLIERATNQDWMLRVKWLYHLAKNIPQGLESIQIHLEASAASLRNFYSHSLSGAVSNVFKILQPNTTDEFVIPLDPRWNMQALDMIRNLMDFDPQTDQPDQLFALLESAANKTIIYLDREKRVFTEANLVSVGSKKLRESVLRMSFEFHQDPESYHTLPHEIVVNLAAFFELCDALVLLWVQSSQGMVSDASANEILGSLRWRDRFWTVADTVKVDAPGLALLALHWHWVLKHLVHQIPRLLMNYEDKYYKEVQTVSEHIQNCLGSQTGGFAGIKKLQKFLGRPFPFKDKLVVECFSQLKVLNKVLAIREQMSALGESGWQEDINRLQVVASQWTLKKSLLQAWGLILRANILEDVSLDELKNFVHAQCLELKAKGLSLGFLEKKHDEASSLSHPDLTSVIHLTRSVQLWPAMEYLAMLWRYKVTADFMAQACLRRCSKNQQPQINEEISHLISFCLYHTPVTPQELRDLWSLLHHQKVSPEEITSLWSELFNSMFMSFWSSTVTTNPEYWLMWNPLPGMQQREAPKSVLDSTLKGPGNLNRPIFSKCCFEVLTSSWRASPWDVSGLPILSSSHVTLGEWVERTQQLQDISSMLWTNMAISSVAEFRRTDSQLQGQVLFRHLAGLAELLPESRRQEYMQNCEQLLLGSSQAFQHVGQTLGDMAGQEVLPKELLCQLLTSLHHFVGEGESKRSLPEPAQRGSLWVSLGLLQIQTWLPQARFDPAVKREYKLNYVKEELHQLQCEWKTRNLSSQLQTGRDLEDEVVVSYSHPHVRLLRQRMDRLDNLTCHLLKKQAFRPQLPAYESLVQEIHHYVTSIAKAPAVQDLLTRLLQALHIDGPRSAQVAQSLLKEEASWQQSHHQFRKRLSEEYTFYPDAVSPLQASILQLQHGMRLVASELHTSLHSSMVGADRLGTLATALLAFPSVGPTFPTYYAHADTLCSVKSEEVLRGLGKLILKRSGGKELEGKGQKACPTREQLLMNALLYLRSHVLCKGELDQRALQLFRHVCQEIISEWDEQERIAQEKAEQESGLYRYRSRNSRTALSEEEEEEREFRKQFPLHEKDFADILVQPTLEENKGTSDGQEEEAGTNPALLSQNSMQAVMLIHQQLCLNFARSLWYQQTLPPHEAKHYLSLFLSCYQTGASLVTHFYPLMGVELNDRLLGSQLLACTLSHNTLFGEAPSDLMVKPDGPYDFYQHPNVPEARQCQPVLQGFSEAVSHLLQDWPEHPALEQLLVVMDRIRSFPLSSPISKFLNGLEILLAKAQDWEENASRALSLRKHLDLISQMIIRWRKLELNCWSMSLDNTMKRHTEKSTKHWFSIYQMLEKHMQEQTEEQEDDKQMTLMLLVSTLQAFIEGSSLGEFHVRLQMLLVFHCHVLLMPQVEGKDSLCSVLWNLYHYYKQFFDRVQAKIVELRSPLEKELKEFVKISKWNDVSFWSIKQSVEKTHRTLFKFMKKFEAVLSEPCRSSLVESDKEEQPDFLPRPTDGAASELSSIQNLNRALRETLLAQPAAGQATIPEWCQGAAPSGLEGELLRRLPKLRKRMRKMCLTFMKESPLPRLVEGLDQFTGEVISSVSELQSLKVEPSAEKEKQRSEAKHILMQKQRALSDLFKHLAKIGLSYRKGLAWARSKNPQEMLHLHPLDLQSALSIVSSTQEADSRLLTEISSSWDGCQKYFYRSLARHARLNAALATPAKEMGMGNVERCRGFSAHLMKMLVRQRRSLTTLSEQWIILRNLLSCVQEIHSRLMGPQAYPVAFPPQDGVQQWTERLQHLAMQCQILLEQLSWLLQCCPSVGPAPGHGNVQVLGQPPGPCLEGPELSKGQLCGVVLDLIPSNLSYPSPIPGSQLPSGCRMRKQDHLWQQSTTRLTEMLKTIKTVKADVDKIRQQSCETLFHSWKDFEVCSSALSCLSQVSVHLQGLESLFILPGMEVEQRDSQMALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 94 - protein, 676 aa, Xenopus tropicalis
MEEEESTEEEEEEGMSFSDPEGFEDDISEEELLGDILKDRPQEADGIDSVVVVDNVPQVGPDRLEKLKNVINKIFSKFGKITNEYYPEAEGTTRGYIFLEYALPTQAQDAVKNADCYKLDKQHTFRVNLFTDFDKYMVIGDEWEAPEKQPFKDFGNLRSWLEDPDCRDQFSVIYESGDRTSIFWTDVKEPVPVEERARWTETYVRWSPKGTYLATFHQRGIALWGGEKFKQIQRFSHQGVQLIDFSPCERYLVTFSPLMDTKEEPQAIIIWDILTGQNKRGFHCESSAHWPIFKWSHDGKFFARMTLDTLSIYETPSMGLLDKKSLKITGIKDFSWSPGGNIIAFWVPEDKDIPARVTLMQLPSRQEIRVRNLFNVVDCKLHWQKNGDYLCVKVDRTPKGTQGVVTNFEIFRMREKQVPVDVVEMKDGIIAFAWEPNGSKFAVLHGEVPRISVSFYHVKNNGKIELIKMYDKQQANTIFWSPQGQFLVLAGLRSMNGALAFVDTSDCTIMNIAEHYTASDVEWDPTGRYVVTSVSWWSHKVDNAYWMWTFQGRLLQKNNKDRFCQLLWRPRPPSLLSQDQIKQIKKDLKKYSKIFEQKDRLSQSKASKELIERRRAMMEEYKTYREMAAKLYMEQKAARLEIRGGVDTDELDSNVDDWEEETIEFFVTEEIIPVEE

SEQ ID NO: 95 - protein, 1921 aa, Gallus gallus
MKSPALQSLSMAGLQLMTPASSPMGPFFGLPWQQEAIHDNIYTPRKYQVELLEAALDHNTIVCLNTGSGKTFIAVLLTKELSYQIRGDFNKNGKRTVFLVNSANQVAQQVSAVRTHSDLKVGEYSSLEVTESWTKEKWSQEFSKHQVLVMTCHVALTVLRNEYLSLSNINLLVFDECHLAIQDHPYREIMKICEDYPSCPRILGLTASILNGKCDPAELEEKIKKLEKILKSNAETATDLVVLDRYTSQPCEIVVDCGPYTDKSGLYGRLLRELDEALHFLNDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERQQFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEVEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTSETETEPIVDDDDVFPPYVLRTDENSPRVTINTAIGHINRYCARLPSDPFTHLAPKCKTRELPDHTFYSTLYLPINSPLRASIVGPPMSCARLAERVVALICCEKLHKIGELDDHLMPVGKETVKYEEELDLHDEEETSVPGRPGSTKRRQCYPKAIPECLRDSYPKPDQPCYLYVIGMVLTTPLPDELNFRRRKLYPPEDTTRCFGILTAKPIPQIPHFPVYTRSGEVTISIELKKSGFTLSLQMLELITRLHQYIFSHILRLEKPALEFKPTEADSAYCVLPLNIVDDSSTLDIDFKFMEDIEKSEARTGIPSTQYTKEMPFIFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTATDAGVGVKSLPADFRYPNLDFGWKKSIDSKSFISIPSSSLVENENYCKHSTIVVPENAAHQGANRTSSAEKHDQMSVSYRTLLDESPSKLQIDVSAELAAINGVSYNKNLANGNCDLVNRDFCQGNQLNYCRQEIPVQPTTSYPIQNLYSSENQPKPSNECTLLSNKYLDGNANRSTSDGCPKMTVTTSTSTALNLSKDKVDSEKNTSSGYSSKTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYIVNQDKSNTDKWEKEETTKENLLANGKLDYDDDDEEDEDLMWRLPKEETDFEDDFLEYDQEHIKFIDSMLMGSGAFVKKISLSHFSTTDSNYEWKAPKKSSLGNVPFSSDFDDFDYSSWDAMCYLDPSKAVEEDDFVVGFWNPSEENCGVDAGKQSISYDLHTEQCIADKSIADCVEALLGCYLTSCGERAAQLFLCSLGLKVLPVIKKTDWESTLCATGENCNSEQKNLSPNSVSACIVNSEPSLYKDLEYGCLKIPPRCMFDHPDAEKTLNHLISGFENFEKKINYSFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQMEKNEMQGMDSELRRSEEDEEKEEDIEVPKAMGDIFESLAGAIYMDSGMSLEMVWQVYYPMMRPLIEKFSANVPRSPVRELLEMEPETAKFSPAERTYDGKVRVTVEVVGKGKFKGVGRSYRIAKSAAARRALRSLKANQPQVPNS

SEQ ID NO: 96 - protein, 1426 aa, Macaca mulatta
MHSSNPKVRNSPSGNTQSSPKSKQEVMVRPPTVMSPSGNPQLDSKFSNQGKQGGSASQSQPSPCDSKSGGHTPKALPGPGGSMGLKNGAGNGAKGKGKRERSISADSFDQRDPGTPNDDSDIKECNSADHIKSQDSQHTPHSMTPSNATAPRSSTPSHGQTTAPEPTPAQKTPAKVVYVFSTEMANKAAEAVLKGQVETIVSFHIQNVSNSKTERSTAPLNTQISALRNDPKPLPQQPPAPANQDQNSSQNTRLQPTPPIPAPAPKPAAPPRPLDRESPGVENKLIPSVGSPASSTPLPPDGTGPNSTPNNRAVTPVSQGSNSSSADPKAPPPPPVSSGEPPTLGENPDGLSQEQLEHRERSLQTLRDIQRMLFPDEKEFTGAQSGGPQQNPGVLDGPQKKPEGPIQAMMAQSQSLGKGPGPRTDVGAPFGPQGHRDVPFSPDEMVPPSMNSQSGTIGPDHLDHMTPEQIAWLKLQQEFYEEKRRKQEQVVVQQCSLQDMMVHQHGPRGVVRGPPPPYQMTPSEGWAPGGAEPFSDGINMPHSLPPRGMAPHPNMPGSQMRLPGFAGMINSEMEGPNVPNPASRPGLSGVSWPDDVPKIPDGRNFPPGQGVFSGPGRGERFPNPQGLSEEMFQQQLAEKQLGLPPGMAMEGIRPSMEMNRMIPGSQRHMEPGNNPIFPRIPVEGPLSPSRGDFPKGMPPQMGPGRELEFGMVPSGMKGDVNLNVNMGSNSQMIPQKMREAGAGPEEMLKLRPGGSDMLPAQQKMVPLPFGEHPQQEYGMGPRPFLPMSQGPGSNSGLRNLREPVGPDQRTNSRLSHMPPLPLNPSSNPTSLNTAPPVQRGLGRKPLDISVAGSQVHSPGINPLKSPTMHQVQSPMLGSPSGNLKSPQTPSQLAGMLAGPAAAASIKSPPVLGSAAASPVHLKSPSLPAPSPGWTSSPKPPLQSPGIPPNHKAPLTMASPAMLGNVESGGPPPPTASQPASVNIPGSLPSSTPYTMPPEPTLSQNPLSIMMSRMSKFAMPSSTPLYHDAIKTVASSDDDSPPARSPNLPSMNNMPGMGINTQNPRISGPNPVVPMPTLSPMGMTQPLSHSNQMPSPNAMGPNIPPHGVPMGPGLMSHNPIMGHGSQEPPMVPQGRMGFPQGFPPVQSPPQQVPFPHNGPSGGQGSFPGGMGFPGEGPLGRPGNLPQSSADAALCKPGGPGGPDSFTVLGNSMPSVFTDPDLQEVIRPGATGIPEFDLSRIIPSEKPSQTLQYFPRGEVPGRKQPQGPGPGFSHMQGMMGEQAPRMGLALPGMGGPGPVGTPDIPLGTAPSMPGHNPMRPPAFLQQGMMGPHHRMMSPAQSTMPGQPTLMSNPAAAVGMIPGKDRGPAGLYTHPGPVGSPGMMMSMQGMMGPQQNIMIPPQMRPRGMAADVGMGGFSQGPGNPGNMMF

SEQ ID NO: 97 - protein, 957 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAERLGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 98 - protein, 785 aa, Canis familiaris
MSSSSPTGQIASAADIKQENGMESASEGQEAPQEVAGGAAAGLSPPAPAPFPLEPGDAAAAAARVSAEEGAAAAANQVQLHSELLGRHHHAAAAAAAAAAAAAAAAQTPLAFSPDHVACVCEALQQGGNLDRLARFLWSLPQSDLLRGNESLLKARALVAFHQGIYPELYSILESHSFESANHPLLQQLWYKARYTEAERARGRPLGAVDKYRLRRKFPLPRTIWDGEETVYCFKEKSRNALKELYKQNRYPSPAEKRHLAKITGLSLTQVSNWFKNRRQRDRNPSETQSKSESDGNPSTEDESSKGHEDLSPHPLSGSSDSVTNLSLPSHMEPVYMQQIGNAKISLSSSGVLLNGSLVPASTSPVFLNGNSFIQGPNGVILNGLNVGNTQAVSLNPPKMASNIVSNGISMSDILGSTSQDVKEFKVLQSSSANSAATTSYSPSAPVSFPGLIPSTEVKREGIQTVASQDGGSVVTFTTPVQINQYGIVQIPNSGTNSQFLNGSIGFSPLQLPSVSVAASQGNLSVNASTSDGSTFTSESTTVQQGKVFLSSLAPSAVVYTVPNSGQTMGSVKQEGLERSLVFSQLMPVNQNAQINANLSSENISGSGLHPLASLVNVSPTHNFPLTPPTLLNPTELNPDLADSQPMSAPVASKSTVTSVSSTNYATLQNCSLITGQDLLSVPMTQTSLGEIVPTAEDQVGHPSPAVHQDFVREHRLVLQSVANIKENFLTNSEGKTTSNLMMLDSKSKYVLEGMVETVCEDLETDKKDLAKLQTVQLDEDMQDL

SEQ ID NO: 99 - protein, 867 aa, Gallus gallus
MNGEQQHDADAGSGVEDMEFSWDEYLEDTGAVAAPHGSFKHVDTSLQNGFAPGMKLEVAVKSDQNTYWVATIITTCGQLLLLRYDGYGEDRKADFWCDIMTADLHPIGWCEQNEKVLKVPEGIKDKIPDQEEFLQRVLKGACSAPANLLEGLHRGKNPLDLIAPGSRLELQNSRDALEAWIVNVVENVGGRLKLRYEGLEDSDKFDQWIFYLDPFLHQVGWATQNGYNLQPPLAIRSLKSEADWQEILKKVKEEEEESSVPTDLFKDKPVIGVHSFSEGMKLEAVDPMAPFVISPATVLKVYNEKYFMIEIDDLRPERATSQSYICHVNSAGIFPVQWSLKNGIHLSPPPGYPGQDFDWADYLKQCGAEAAPQSCFPSLTSDHGFKENMKLEAVNPVDPEEVCIATVTKLKDSYLWLQLEGSKKPIPDCIVSVESMNIFPVGWCETNGYQLRPPRKAIVNKQKKIAVVQPEKQILSSRSVHDGLKNQELNSSDSVVINGKYCCPKIYFNHRCFSGPYLNKGRIAELPQSVGPGNCVLVLKEVLTLLINAAYKPSRVLRELQLDEEAAWHGHGETLKAKYKGKSYRATVEVVRTADRVADFCRKTCIKLECCPNLFGPQMVLDKCSENCSVLTKTKYTHYYGKRKNKRIGRPPGGHSNLEVAMKKPNKRRKKRKHFFVHKKKRSSTSVDNTPAGSPQGSGGEEEDDQDEVDEESLTEDSTSEQQDELLEESEVSEKKSLSSSPTQSELSHSLTQDQDKRKRKLRTFSFSDDENKPPSPKEIKIEVAEKLQLDSNPLEWSVADVVRFLKSTDCAPLARIFLDQEIDGQALLLLTLPTVQECMDLKLGPAIKLCHHIERVKLAFYQQFAN

SEQ ID NO: 100 - protein, 780 aa, Gallus gallus
MGPDGMPLAVLPAFRQGANQQRALVVANVNCTRGRVSRDVGCGLREAGSFWVFSRIPPTNDFKVGMKLEAHDPRNVTSVCIATIIGITGARLRLRLDGSDNKNDFWRLVDSSDIQPIGTCEKKGGMLQPPLGFQMNASSWPMFLLRTLNGAEMAPAAFFKKEPPKPAANCFKVGMKLEAIDRKNPYLICPATIGDVKGDEVFVTFDGWRGAFDYWCRCDSRDIFPVGWCSLTGDALQPPGNNDPLTQHNLWSPSEGWGEGSMSSCFRICLSIITQSKKQNLVLCGLGHCFVLATISITKSSAKIQSSPSKVTRRSMQSPQKSAPVPAQRGRKPGRGKPPGQSTVPKKGRSPKNIPLTKSTSHTENLKSRKKSLKPGKKKKVLPEQLIPAPPSPLSSPDGDSGTTQILKDGISLSGATAAVISTVCVYVNKHGNSGPHLDKKKVQQLPDHFGPGAVNVVLQQAVQACVDCAYQSKTVFGFLKSGHHGGEMITASFDGEKHAINLPSVNSASFVLRFLEKLCHSLQCDNLFSSQPFSPYMGCAHSPTEYDRNKPAKEEIPENGSAKRYSQDSPPYTAPLSPKLPRGDAHPSEAETLPVEENSTSKEHRFSEDSMDSALNSVNLSSPARRNSTEYRTSGSAAYYRNSFQPVTATSNSAPILCRLSLSSAGNSSYYEVSRNRIQRRIEAASSTTGPDLSSLKREPSRILNKDPSTWSIEEVMCFVKEADPQALAPHAELFRRHEIDGKALLLLRSDMIMKYMGLKLGPALKLCYHIERLKQGKY

SEQ ID NO: 101 - protein, 740 aa, Xenopus laevis
MPDHDSTGLLSRQTKRRRVDIGVKRTVGTASAFFAKASATFFSAMNPQGSEQDVEYSVVQHADGEKSNVLRKLLKRANSYEDAMMPFPGATIISQLLKNNMNKNCGTEPSFQASGLSSAGSEIHQEDACINSSRDSPQECLSPFGRPTMNQYDMDRLCDEHLRAKRARVENIIRGMSHSPNVALRGNENDRDGAPRSISPRESYRENRRKQKLPQQQQQSFQELVSARKEQKREERRQLKQQLEDMQKQLRQLQEKFYQIYDSTDSENNEDGNLSEDGMHSEIIDARAQDSMGRSNNEMFDLDPGQFIDRARALIREHQIASDNHHKKDAPPKDKDNLHHPFQPEGKHLAEALKQELNAAMAQVVDTVVKVFSAKPIRQLPQVFPPLQIPQARFAINGEHHNFHTANQRLQCFGDVIIPNPLDTFSNVPMPSSTDQTEALPLVVRKNSNDQSASGPPPGSHHPSLHQSPLSAAASFSSSSFRHPFPLPLMAYPFQNPLGAPFISFQGKDSSSPESLDLTRETTSLRTKMSSHHMNHHPCSPAHPPSSTEGLSLSFIKSECGDMQDMSDISPYSGSALYMQEGLSPNHLKKAKLMFFYTRYPSSNMLKTYFSDVKFNRCITSQLIKWFSNFREFYYIQMEKYARQAINDGITSTEELCITRDCELYRALNMHYNKANDFEVPERFLEVAQITLREFFNAIIAGKDVDPSWKNAIYKVICKLDSEVPDIFRSPNCLQELLHE

SEQ ID NO: 102 - protein, 2186 aa, Canis familiaris
MAAFGILSYEHRPLKRPRLGPPDVYPQDPKQKEDELTALNVKQGFNNQPAVSGDEHGSAKNVNFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAITETKVKKRHVIDPFMEWTQIITKYLWEQLQKMAEYYRPGPTGSGGCGSTIGPLPHDIEVAIRQWDYNEKLAMFMFQDGMLDRHEFLTWVLECFEKIRPGEDELLKLLLPLLLRYSGEFVQSAYLSRRLAYFCTRRLALQLDGMSTHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDSERKETEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETGGFESTSYLPSPDWSLSTVPSGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKSKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTTSNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAVLLLEIIISGTVDMQSNNELFTTVLDMLSVLINGTLAADMSSISQGSMEENKRAYMNLVKKLRKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPAPKTEDYGMGPGRSGPYGVTVPPDLLHHANPSSISHLSYRQGSIGLYTQNQPLPAGGPRVDPYRPVRLPMQKLPTRPPYTGVLPTTMTGVMGIEPSYKTSVYRQQQPTVPQGQRLRQQLQAKISQGMLGQSTVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQAPMIGTMTPLGAQGVQAGVRSASILPEQQQQQQQQQQQQQQQQQQQQQQQQQQQQQQQQQQYHIRQQQQQQILRVRPQQQQQQQQQQQQQQQQQQQAHQQQQQAAPPQPQPQSQPQFQRQGLQQTQQQQQTAALVRQLQQQLSNTQPQPSTNIFGRY

SEQ ID NO: 103 - protein, 1156 aa, Homo sapiens
MGDTAPPQAPAGGLGGASGAGLLGGGSVTPRVHSAIVERLRARIAVCRQHHLSCEGRYERGRAESSDRERESTLQLLSLVQHGQGARKAGKHTKATATAATTTAPPPPPAAPPAASQAAATAAPPPPPDYHHHHQQHLLNSSNNGGSGGINGEQQPPASTPGDQRNSALIALQGSLKRKQVVNLSPANSKRPNGFVDNSFLDIKRIRVGENLSAGQGGLQINNGQSQIMSGTLPMSQAPLRKTNTLPSHTHSPGNGLFNMGLKEVKKEPGETLSCSKHMDGQMTQENIFPNRYGDDPGEQLMDPELQELFNELTNISVPPMSDLELENMINATIKQDDPFNIDLGQQSQRSTPRPSLPMEKIVIKSEYSPGLTQGPSGSPQLRPPSAGPAFSMANSALSTSSPIPSVPQSQAQPQTGSGASRALPSWQEVSHAQQLKQIAANRQQHARMQQHQQQHQPTNWSALPSSAGPSPGPFGQEKIPSPSFGQQTFSPQSSPMPGVAGGSGQSKVMANYMYKAGPSAQGGHLDVLMQQKPQDLSRSFINNPHPAMEPRQGNTKPLFHFNSDQANQQMPSVLPSQNKPSLLHYTQQQQQQQQQQQQQQQQQQQQQQQQQQQQQQQQQQSSISAQQQQQQQSSISAQQQQQQQQQQQQQQQQQQQQQQQQQQQPSSQPAQSLPSQPLLRSPLPLQQKLLLQQMQNQPIAGMGYQVSQQQRQDQHSVVGQNTGPSPSPNPCSNPNTGSGYMNSQQSLLNQQLMGKKQTLQRQIMEQKQQLLLQQQMLADAEKIAPQDQINRHLSRPPPDYKDQRRNVGNMQPTAQYSGGSSTISLNSNQALANPVSTHTILTPNSSLLSTSHGTRMPSLSTAVQNMGMYGNLPCNQPNTYSVTSGMNQLTQQRNPKQLLANQNNPMMPRPPTLGPSNNNNVATFGAGSVGNSQQLRPNLTHSMASMPPQRTSNVMITSNTTAPNWASQEGTSKQQEALTSAGVRFPTGTPAAYTPNQSLQQAVGSQQFSQRAVAPPNQLTPAVQMRPMNQMSQTLNGQTMGPLRGLNLRPNQLSTQILPNLNQSGTGLNQSRTGINQPPSLTPSNFPSPNQSSRAFQGTDHSSDLAFDFLSQQNDNMGPALNSDADFIDSLLKTEPGNDDWMKDINLDEILGNNS

SEQ ID NO: 104 - protein, 761 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 105 - protein, 351 aa, Xenopus laevis
MSCPNNVTPNSFLMDSLAGSCRGDNYSTSPGMYLQTGSEFSCGMMRNCGIVPSLSKRDDVNNPGLSLNTYPSYLSQLDNWCDPKNTYRIEQPVARQLSSCSFPTNVKEENVCCMYNTDKRAKNATEAALYPNQMPETRPSDHEVPVPSYYRATQGYPMDKTPSCHSTGDFETSFENRTSVNARSEILEQQQAVGKGGFPENTKTDNQTLATNLSTSSSSSSDIKTEKSLPAPKLPPSEGDKELSKNTDTSTDNSDTEAKEDIKAENAAGNWLTAKSGRKKRCPYTKHQTLELEKEFLFNMYLTRERRLEISKSINLTDRQVKIWFQNRRMKLKKMNRENRIRELTSNFNFT

SEQ ID NO: 106 - protein, 407 aa, Xenopus laevis
MQNSHSGVNQLGGVFVNGRPLPDSTRQKIVELAHSGARPCDISRILQSHADAKVPVLDSQNVSNGCVSKILGRYYETGSIRPRAIGGSKPRVATPEVVNKIAQYKRECPSIFAWEIRDRLLSDGVCTNDNIPSVSSINRVLRNLASEKQQMGSDGMYDKLRMLNGQTGTWGARPGWYPGTSVPGQPAQEGCQPQEGGAENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVFQAIPQATTPVSSFTSGSMLGRTDTALSNSYSALPPMPSFTMGNNLPMQVSFPLECQSQFKYPAVNLTCLSTGQDYSKNRVNLTNDFMENSWMFSSIL

SEQ ID NO: 107 - protein, 621 aa, Homo sapiens [sequence omitted]

SEQ ID NO: 108 - protein, 1185 aa, Gallus gallus
MERSALQWVGAPCGSHGPYVFYRAFRFQRRGGGRARVLSLGDFFFVRCRAEEPACIAELQLLWEERTSRQLLSSAKLYFLPEDTPQGRTSDHGEDEVIAVSEKVTVKLEDLAKWAQSDFSKWKCGFRAEPVKPMDVGKNGQKEALMRYRQSTLNSGLNFKDILKEKADLGEDDEDSNLLILSYPQYCRYRSMLKRIQDKPSSILTDQFVLALGGIAVTSKNPQIFYCRDTFDHPTLIENESICDEFAPNLKGRPRKKKPCPQRRDSLNGIKDSNNNSESKAVAKVKCEAKSALPKPKSNNSNCKKGSSEDKSKIAVGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPVKPRKQDNSSQEGEAKTKVSGTKRIKNENQKSKKEKDNAQKPQDASEVSSEQEKDQESADQKNFTEHPTAGETKQPNQGPPPLLPEAARPLPMEKIDVTENSSSSEKAKEEVPHLSSFPSLSMPPDEDTVLDATVTKRLHSSADTQEDTKPERRIHKAFTESLENEPPEMPFSTFPVQLPTQSDMEDDKLPEMADYIANCTVKVDQLGNEDIHNALKQTPKVLVVQNFDMFKEKELPGSMSDDSTFGYTPLLYSKGNPGIMSPLAKKKLLSQVSGAALSCSYPYGSPPPLISKKKLNSRDELSSSLSQGPHVPNSDPIAINRPSVIQHVQSFKSKEERKSINDVFKHDMLSKVDPQRCDFSQHCLSSLAESYVPKTDIQDCKDKMTEKRALQHSRVPTFLADFYSSPHLHNLFRHTEHHLNNEQTSKYLPRDMFRESENISTFTQHKHQEKLNLNYHPSLHQQEKKATVEASSDDQPTDLSLPKSIHKQTAKAPGPGLSHSSMAQQEGKGVSLFQAASSQAVSLDCNPKACRVSPMAMTAPKKHSELLHRSGKQQAQRLENLRKMEGMVHPIISRRMSPQNIGAARPLKRGLEELDKVISEKKVRAVSPLHLPKETSVKEKVPDAEGEGSKSLHGLHSGSVLESHKFPLSAPIFPGLYPGTLCTGLNNRLPPGYSHPLQYLKNQTVLSPLMQPLALHSLMVQRQFLTSPANSQQLYRHLATATPVGSSYGDLLHNSIYPLAAINPQAAFPPSQLSSVHPSTKL

SEQ ID NO: 109 - protein, 958 aa, Xenopus laevis
MMSVLKIENFDPYSCNGIEDRNGMGYSTALLNPIVLGQDLLMSYLSIIEQPKQRGFRFRYVCEGPSHRGLPGASSEKGKKTFPTVKIFNYVGMARIEVDLVTHTDPPRVHAHSLVGKHSNKTGNCIVTVGPEDMTAQFNNLGIVHVTKKSQTEILKEKMKRNILRNTGRNTLTEVEERKIEQEVKDLKKVTDLSIVRLKFTAYLPDSNGAYTLALPPVISDPIHDSKSPGASNLRISRMDKTAGSVKGGDEVYLLCDKVQKDDIEVQFYEDDENGWHAFGDFAPTDVHKQYAIVFRTPPYHTQKIDRPVTVFLQLKRKKGGDVSDSKQFTYYPLEQDKEEVERKRRKDLPTFNNHFYGGGSPMGGAPPGSSFGQGGGSNINYQYTGMNSAFYMSSPAGGGYHSSGHMMKHCSATNSSEKNQQPSISIKKEGEEASACSQTDSATTAQKEAQCQMIMRQANLRMLSLTQRTSRALLDYATTADPRMLLAVQRHLTATQDENGDTPLHLAVIHGQSSVIEQLVQIILSIPNQQILNMSNHLQQTPLHLGVITKQYSVVAFLLKAGADPTILDRYGNSVLHLAVQSEDDKMLGVLLKYPSVGQKNLINMPDYHGLSPVHWSVKMKNEKCLVLLVKAGANVNSAERKSGKSPLHIAVEMDNLNLAVFLVKKLHADINAKTYGGNTPLHLAASRGSPMLTRMLVNEGANVLSENDEPVNKLPSCNSDTSESDSDVQMDTDSDHHGDSDTDSSTAVDSECEHSAEEMHRREQRNIRPHCAMKRRYSGHTAVDLTKSQKVRDILSKHTPGSASWKQKGPEPVNVLALETNTVQRLEKLLNEGQTGADWTELASRLRLQSLVETYKNTSSPTESLLRNYELAGGNLKELINTLQSMGLNEGVELLCKSETYAKHHSPAESKNDSAYESQSMEVDQSSGNLMDDSQKQTIPVSAAELCPTTEPTIGQ

SEQ ID NO: 110 - protein, 775 aa, Homo sapiens
MAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 111 - protein, 503 aa, Homo sapiens
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 112 - protein, 1049 aa, Mus musculus
MQFGTRTTAAEPGFMGTWQNADTNLLFRMSQQVPLACAGRVLGADFCPNLEEPDQRLEVQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKILDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSISTQNEYNESSESEVSPTPYKSDQTPNRNALTSITNVEPKTEPACVSPIQNSAPVSDLSKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLTLTSPGRPPMGFTTPPLDPVLQNPLPSQLVFSGLKTVQPVPPFYRSLLTPGEMVSPPTSLPTSPIIPTSGTIEQHPPPPSEPIVPAVMMGTHEPSADLAPKKKPRKSSMPVKIEKEIIDTADEFDDEDDDPNDGGTVVNDMSHDNHCHSQDEMSPGMSVKDFSKHNRTRCISRTEIRRADSMTSEDQEPERDYENESESSEPKLGEESMEGDEHLHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMSLDSSQPSLSKDLRDEFLMKIYGAQHPLGLDGREDASSPAGTEDSHLNGYGRGMAEDYMVLDLSTTSSLQSSSSVHSSRESDAGSDEGILLDDIDGASDSGESTHKAEAPTLPGSLGAEVSGSLMFSSLSGSNGGIMCNICHKMYSNKGTLRVHYKTVHLREMHKCKVPGCNMMFSSVRSRNRHSQNPNLHKNIPFTSID

SEQ ID NO: 113 - protein, 1937 aa, Homo sapiens
MASGLGSPSPCSAGSEEEDMDALLNNSLPPPHPEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRGVCGRPRPPPMGRSTRAVGPAHLPSLPPDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 114 - protein, 1217 aa, Takifugu rubripes
MATLYVSPHLDDFRSLLALVAAEYCGNAKQQSQVWQWLSFADNELTPVSCAVVFPLMGMTGLDKKIQQNSRVELMRVLKVLDQALEPRTFLVGESITLADMAVAMAVLLPFKYVLEPSDRNVLMNVTRWFTTCINQPEFLKVLGKISLCEKMVPVTAKTSTEEAAAVHPDAAALNGPPKTEAQLKKEAKKREKLEKFQQKKEMEAKKKMQPVAEKKAKPEKRELGVITYDIPTPSGEKKDVVSPLPDSYSPQYVEAAWYPWWEKQGFFKPEFGRKSIGEQNPRGIFMMCIPPPNVTGSLHLGHALTNAIQDTLTRWHRMRGETTLWNPGCDHAGIATQVVVEKKLMREKGTSRHDLGREKFIEEVWKWKNEKGDRIYHQLKKLGSSLDWDRACFTMDPKLSYAVQEAFIRMHDEGVIYRSKRLVNWSCSLNSAISDIEVDKNELSGRTLLPVPGYKEKVEFGVLVSFAYKVDGSDEEVVVATTRIETMLGDTAVAVHPSDSRYQHLKGKTVLHPFCDRKIPVVFDDFVDMSFGTGAVKITPAHDHNDYEVGVRHNLAFINILDENGFVINVPPPFLGMKRFDARKAVLQALKDRDQFKEIKDNPMVVPVCSRSKDIVEPLMKPQWYVSCSDMGKQAADAVREGRLKIIPDHHSQTWFNWMDNIRDWCISRQLWWGHRIPAYFITVSDPSVKPGEDMDGHYRVSGRTPEEAREKAAKRFNVSPDKIALRQDEDVLDTWFSSGINPFSILGWPNETEDLNVFYPGTLLETGHDILFFWVARMVMMGLKLTGKLPFKEVYHCAVVRDAHGRKMSKSLGNVIDPLDDHIGIALEGLHAQLMDTNLDPLEVEKPKKVQKADYPNCIPECGTDALRFALCAYTSQGRDINLDVNRILGYRHFCNKLWNAVKFAMRTLGDQFVPADTSPAEREESVSDRWILSRLSTAVAQCDAAFRTYDFPAITTAIYNFWLYELCDVYLESVKPVFIKAKEDGSCERPAAVCRQTLYTCLEVGLRLLAPLMPFVTEELYQRLPRRRPQSDPPSICVTPYPDAAEFCWQCEDVDRDIDFIMGVVRTIRSLRSDYKLTKTAADCYLQCTDAATVSLVQKYSLQIQTLSYSQAIVPLMAPQPAPEGCAVAIASDRCTVNMMLKGLIDVEKEVPKLMGKKTDLEKQIEKLSEKISKGDYKEKVPVKVQEQDTEKLRQSQTELEKVKEAMDNFQKMM

SEQ ID NO: 115 - protein, 1255 aa, Gallus gallus
MRRGGWRKRAGEGDGWGGWGGYMSAKVKKLEDQFRSDSAIQHQRDGNSSSIFSGVAIYVNGFTDPSADELRRLMMLHGGQYHVYYSRSKTTHIIATNLPNAKIKELKGEKVVRPEWIVESIKAGRLLSHIPYQLYTKQSSVQKGLSFNSICKPEDAMPGPSNIAKDLNRVNHIKQCEMESEITPNGISSWNEEEEEDSDGLGFTKLDQILPERKQNGIQSHKDSTAIFNGHTHNTCTSALKTQDCLVPSSNSVASRFSPGPVQEEGKPEKGIVDFRDCTMQQLQQSNKNTDFSWNPHRTMSNSSSSSSLHSNTKINGAHHSTVQGPSSTKSTSVPTPSKAASLSVSKPSDCSFISDFYSRSRLHHISTWKCELTEFVNSLQRKNSGVFPGREKLKKWKAGRSALKTDTGNVSVASSAKPQSCIMHVDMDCFFVSVAIRNRPDLKGKPVAVTSNRGAGKAPLRPGANPQLEWQYYQNKLLNGKAEIRIPDKLDSWVWEHSDSAHMNGVDCDLTVLSMAEIASCSYEARQAGIKNGMFFGQAKKLCPNLQAVSYDFNAYKEVAQTVYEILASYTHNIEAVSCDEALVDITEILTETRLTPDELANAIRDEIKAQTKCTASVGMGSNILLARMATRKAKPDGQYHLKPEEVDDFIRGQLVTNLPGVGRSMESKLASLGIRTCGDLQCASMSKLQKEFGPKTGQMLYRFCRGLDDRPVRTEKERKSVSAEINYGIRFTQPKEAEAFLLSLSEEIQRRLEAAGMKGKRLTLKIMVRKAGAPVEPAKYGGHGICDNIARTVTLDHATDSAKVIGKETLNMFHTMKLNISDMRGVGIQVQQLVPISKTTSAQSAVQSGRLPGGSHSVIDLLHVQKAKKCSEEEHKEVFVAAMDLEISSDSRTCTVLPSRGTHLTAGLNSNVSKTDSTVKLNGLHSPISVKSRLNLSIEVPSASQLDKSVLEALPPDLREQVEQIYTIQQGETYGDSKREPINGCNTALLSQPVGTVLLQVPELQEPNANMGINVIALPAFSQVDPEVFAALPAELQAELKDAYDQRQKQPEQQPANAFVSKNPCLQLKHATTKNKKKIRKKNPVSPVKKIQSPLKNKLLGSPAKNMPAASGSPQKLIDGFLKQEGAAAQLEAVPSTSDASDPSALQTEQCGSFRPQAPNLAGAVEFNDVKTLLKEWITTISDPMEEDILQVVKYCTDLIEEKDLEKLDLVVKYMKRLMQSSVESVWNMAFDFILDNVQVVLQQTYGSTLKVI

SEQ ID NO: 116 - protein, 1385 aa, Homo sapiens
TPAAIPTSAPIPASFSLSRVCFPAAQAPAMQKVPLSFQPGTVLTPSQPLVYIPPPSCGQPLSVATLPTTLGVSSTLTLPVLPSYLQDRCLPGVLASPELRSYPYAFSVARPLTSDSKLVSLEVNRLPCTSPSGSTTTQPAPDGVPGPLADTSLVTASAKVLPTPQPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSGSICSSFAGMADSDMGSQEVFPTEEEEEVTPTPAKRRKVRKTQRDTQYRSHHAQDKSLLSQGRRHLWRAREMPWRTEAARQMWDTNEEEEEEEEEGLLKRKKRRRQKSRKYQTGEYLTEQEDEQRRKGRADLKARKQKTSSSQSLEHRLRNRNLLLPNKVQGISDSPNGFLPNNLEEPACLENSEKPSGKRKCKTKHMATVSEEAKGKGRWSQQKTRSPKSPTPVKPTEPCTPSKSRSASSEEASESPTARQIPPEARRLIVNKNAGETLLQRAARLGYKDVVLYCLQKDSEDVNHRDNAGYTALHEACSRGWTDILNILLEHGANVNCSAQDGTRPVHDAVVNDNLETIWLLLSYGADPTLATYSGQTAMKLASSDTMKRFLSDHLSDLQGRAEGDPGVSWDFYSSSVLEEKDGFACDLLHNPPGSSDQEGDDPMEEDDFMFELSDKPLLPCYNLQVSVSRGPCNWFLFSDVLKRLKLSSRIFQARFPHFEITTMPKAEFYRQVASSQLLTPAERPGGLDDRSPPGSSETVELVRYEPDLLRLLGSEVEFQSCNS

SEQ ID NO: 117 - protein, 1443 aa, Xenopus laevis
MVAKRKLSRSDDREESFTADTSKNKKCRTSSKKSKALPQDGVVENDSIFVQLLKSSGMTLKCGDRQNEIAVDQAVFQRKLQQALRKHPRHPNVIQEFISGLESHIEDRDIFRNCLLPCGNRQETEASTMTGSFHDSLIKLLLGTDILQESVINTLFEKLPEFLYDSVGSDGISIPRLIINQFKWLDRILDCKDLTLKIMQLISVAPVDIQHDIVTSLPEILEDSQHNDVARELNSLLQQNTQLTVPILDALSSLNINADLLSEVRQSVMSTLSAVELEDLPVIIKFILHAVTPSDALEVISELRKKLDLESCSSLEQIYATQSKERNKPHAGSSVNKTKSSDCVSLMMDVIKSSVRFQKHTSEAWMKAIENVDTVGDHKVSDLIVLLILYTTQTNSSKKQAERVLRNKIRSGFILDQLLQNAFRNHSQVLRDYFPSILSLAQSMLRSAEQSVVSFGSLMYKSAFSSFDSYCQQEVVGALVTHVCSGYAAEVDVSLDVLTDLVSSHAAAVALYAVFVKGILDYLDNLNAQQIRKLFHILSVLAFSRGQEGGHIQDDMFIVIRKQLSSTVLKYKRIGIIGAVQMVGSMAMNKKHGSKHPENKPLSAETFRQVTALLELLQTCSERVAEASALYYDELSSLVQKRNLDPQVMSLVGKTVLTDFQDDFVEDLTPTEEGNYIFPLKAMYNLDEDDSQGGIAINLLPLLSQDMRNRGAEQVANKEGRVVSPICLSPFFRLLRLCIEDQHEGNLEEIDALLGCPLYLTDLEITEKMESLSKQEREFLCSLLFFALNWFREIVNAFCKQQDPDMKGKVLTRLQNITWLQSVLEKCLAASPGYIPSSAHFDSEPQEVLPSAIAPAPAKKAKKGKTPKSAGSKNASADSSQLEEHMDTEKSELEKTQPEKEKEESKPSINLNNYRAYFRELDLEVFTVLQCGLLTRSLLDSEMHTKATEVVQLGPAELVFLLEDLFRKTENILTSAAKRVTFLKVKKGRNLGFSQLLQKTPQEVAQAVIHLLNSLCNHIENMHNYFQTLMLENHGVVDAPGVDIKEHQYMSTCYQLLLQVFHTLFCWNGFSQHENRKLLKSALIALAGRLKETETEPALDDLVRQSFNYLKNLHSSVPTCSSALCLTQLLIVIAEKTNVLQYREQIASMAKQFLCQAWIQPSGEREKGIRYHENLQSLLCIYLENTDDVLKAVEDIAGVGVPELVNAAKDAASSSYPTLTRQTFVVFFRVMMDKLEKCVKSIPNSKKAETLQEQTEQLLSWNLAVRDFHILVNLVKVFDSRPVLSICLKYGRLFVETFLKLGMPLLDCCFKKQREDVQSLLKTLQLSTRQLHHMCGHSKINQDTALTNHVPLLKKTLELFVYRVKAMLVLNNCQEAFWLGNLKNRDLQGEEIVSQVSQESEAEEEQESQLPPEEEEAEEEEENEGSDKEIEGGDEDNEDEDSD

SEQ ID NO: 118 - protein, 1624 aa, Homo sapiens [sequence omitted]

SEQ ID NO: 119 - protein, 2320 aa, Homo sapiens [sequence omitted]

SEQ ID NO: 120 - protein, 2000 aa, Strongylocentrotus purpuratus
METNETSTNHGSDMAFKKVEVVTALKMAGKNTKMMKAARLAKAKPTPSMEIKRVDLKLPPRPLSSPPVEIPEPESPSLKSPVPDSPTPDREAPSSPAPENPPTDSPPVESSPNDGLAPAPESYRSQESPDADTPTVDTSPSENKLQVNTAAESSHPDSSPLEIPQENVPKESKPVESSGKESSPQESSPPELPRENVPQESKPVKSSKKESSQPESSPPGLPQENVPQETKPLEGSGKESSPPESSPPELSQENVPQETKPLEGSGKESSLPESSPPELPQENVPQETKPLESSGKDSSPTESSPGESSKETATETAENNVPGVPVEGVDDGHDNGSDDDGNSDGSDDDDDDDDDESEDGCDYLYDDDSDCDGGWCARTPSPSVESLKPLEAALELVGPPNSHYVIYHSKSATFAETHQDKLRGKVVHLQAFSGINPTTLLGDASKFVGRSMLVMCSHSLQDEDSTTSALYQVTLMKGQTGVTFIAGMSGVMKSAADAWTISMTDKRALQIVGPNGPCRYALFTNIPEDVHDPKERCFQNGCLATGDSETAEGGLIIDDDNLTIWVDYMTKVLVTCDGVTVQKVEGGKWMEQPDGRLAFQRGLTEKEKSPGLKVYRAFALRKDLNGADVSIELGGSPHQVIKQPPGVAYALNCGGPAYHALNGAVFVDTQTQFKPIETGGLDCMHKFSAHTAQDRNLHSLLSSTYDSFLFSSYNCTHDGFNDKIKFPLPLSGGDYTMRLYTVGGWMTKGYIHYDSTELTSQILDQLTSEDHIHAVGTTAKTCEVPIKVEKENTTLSFRTNGDDVCLSGILVYDKDFKEPTLTPEERQKETKIKQELADKLLPLNRTFSLKEMKIAGWSKNLLENASGEASESFHEGGCKGGFYSFTVSLLDASDNVIAKQTTGRKGSITTSGWIKESFTFKDYGPGVRTVCFESHGEDDKGWAGAFGSWISAGALRVKSEISAASGDEYSDVETSTAEERKQGVTSFLRHLQEEHRDSLKFMLTSSEADKQGDEAAKDKQVKPEEVIQPMIIVKKKTVKREIRVFVSSTFRDFEEERELIIKKVFRELNRLCLDRGVFFTYVDLRWGITEQQSKGGRTIEICLREIDKCRPYFICMMGDRFGWSQSSKFKDELLDKSYDTVVDAYRQFKWVDEYRFNSSVTQLEVMYGAMRKHKEIKKERIFFYLRKPMVKREDLPPPVETEEDRKNVKGETQWHFDLQTKLRNCVAESGHTKRTYESAVDAASMIKEDLIKCINEDFPPGTNLTALQRESEAHDAFANARRRVYIGRQEYFDYIDNYFAQKPEGPLTIIGESGSGKSALVANWCGRFEERNPGTFLFKHFIGSSAESASHVNLLRRLYGEMKQFYNLEMEIPTSDRNLIIDLPSWLNIASNRSKLMIVLDALNQLDSGAGGSGDEKSLTWLPQTLPNNVQMLLSTLPGETQDVIELSGWPMYKIQGLQENEKLDIITGYMDLYGKTLNKEQTDLITNAKQSSNPLYLKALLDEVRVYGDFFKLTPAIKSYLTAEDPGALFVKVLQRLENDFEKGAVCRPNLVRDTTTAIWCSHRGMSESELLTLLKIPSAVWSPFYLSLEDNLINRNGLLNFFHDHLRQAVERRYLPTDEDKRKKFVELSNFFNAQDIDDRYSDEVPYLLIQAKELTRLKATILNVNVFQFLMKTEDGNFQLIMAWRMLGGFEPVEQAYLDVLSKCEVNWEQDKDKVELIKFMAVFFMQLGLLTGARVLNERLLKEIELRYLAEHSTIVRHHFNYSMKLKCNHPTVIDVLIELGNVCLKQGNFKASEEYLEDALSRLTKVKTPQQKLQLVKAVITMVSVQRRQGDIDFAKKLLMRALGVSKEVVGHDHHYTAALLGMLGEILYDQSRLEEAVACHTFDFNETQREGGPEHPHIAAILNNIGLVQDDMNASGTQKTFSLALGILLEAYGKDHVDVATVRYNLGAQFFGNQMFQRAKYQFEEAYRVFKLFLGEHHTSTRVAKKAVDMVEDL

SEQ ID NO: 121 - protein, 823 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 122 - protein, 323 aa, Homo sapiens
MTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 123 - protein, 1219 aa, Danio rerio
MARAAACVPQELPDPLRLSEPSVPAELKLHAPGPLQLHDPGPLLLHAPGPPQLHGLGLSELNTPAHPQLHAPGLLQLHAPGPPQLHSLGLSELQTPAPPQLHAPSLPQLHAPDPPQLHTPGLPQLHVAFLSISDTNTARESLAEVTGNVTSALSSGSAVGFDLEWPPSFTKGKTKKVAMVQLCASEDKCYLFHISSMSGFPPGLKMFLEDENIMKVGVGIEGDKWKLLSDYDIKLKNIVDLSDLANEKLRCCEKWSLDGLVKHLLKKQLFKDKLVRCSHWDDFSLTEDQKRYAATDAYAGLLIYQKLQEMISGCSGSSALSLKERVFKIACDLKDLADHIPNELDCTDGAGRLVDDLSQTLTSLRCVLSNANKPTEQLVEEKPSPGLILDDTSSHHEGVPTTEEQSHSQCVENPGRPPQRECAMSLDISEYELQMLEEQARQEQLEEECILAFQTQHASGPQDLNATESDEEFDDEMMKCADDIEKINNAQMPQSGAEDEDEDVEEDEEEGLDSSIPQPVPEQIKCLKMFFGHHSFKPVQWKVIQSILTERRDNLVVMATGYGKSLCFQFPPVYCQTISVVISPLIALMEDQVLQLTYSETDGKMGKCKFANSWLEKDEFKQRLKPVAENNRFICSWNVDMPFSKPGKLMSNIPACFLGSAQTKNLNEQVKRGDFRVVYMTPEFCSGNIPLLVQLDRTVGLSLIAVDEAHCISQWGHDFRSAYRELGKLKKNLPTVPFLALTATASPSIRDDIIKSLHLINPMITCTSFDRPNLYLDVNRKSGDVIQDLKRFLVKKKGGGYEFEGSAIVYCPSKKEAERVTTALFKLDIPCGVYHAGLSIKQRRETQHQFMRDEIQCVVATVAFGMGINKSDIRKVIHYGAPKEMESYYQEIGRAGRDGLPSACHVLWMPGDMALNKFILNQSKSERFRSYKIDMMAKMEKYLNSTKCRRKLILCHFEDKRLRKVTSGILGSSQCCDNCRSGVNEEDLEVLQQDFGLCAYQLMKAISVMEERFGITAPILFLRGSCSQRVPERFRKHSLFGIGRDVSETWWKALGRELIAEKYLMEVTGHSKFTTLCKITTKGRSWLSKAEDEKHRQLLLQPNRDLFSRVCAPRRKADPAQVEPTVSNLQSPHIRRTKLGSESPQIVKKGDLPSRSAARQTQIQTDVRAQTPGASAKEIQLQSELYGKLVSERQKLASIRDIPPALLATNKILLDMSKL

SEQ ID NO: 124 - protein, 1001 aa, Xenopus laevis
MKLDVSFQRKKSEDSDEEDLCAISDKWRFQRLSRQWSRVDDIDSLFGRSERLGSSGEMKNTTSSESVLTDLSEPEICSIHSGSSGGSGCRCSYVGTSASRETFECADTMCIHDSNSMTILPPWPKDCPDGKLNGKNEKPAHTKTKTFLKCMGTLRSKGTYGKSKGLQRTGAIIISEPILQLEPDPLKTNTQLDPDPLKTMSCVGNGQVKDSAMNFTTTGILDSVSEIKACTESTSFLEEIPAPESNKRGGMYLEDIDVFTDLGTSKAGHNHNHNFHSQEDLVVHIPKDHKPGTFPKALSIESLSPIESFYGVNWRSAGISLSRQKGIRAKEPRIMSSRCSRGSRLSVYDNVPGSHLYASTGDLMDLERDDLFPHLDDVLQHINGLQQSVYHWSKDIMPDLQDDNLSVGESGTSTFHSPNPMSLDFEGNSISDGRTTPSDMERDAASLNESDTTGTRERRDSGVGASLTRTNRRLRWSSFHISHQQSGSVASLQISNQSAGQLNLLQKFSLLRLTAIMERYSLSNKHGWTWSVPKFMKRMKGPDYKDKNIFGVPLMVHVQRTGQPLPQNIQQALRFLRGHCLDQVGLFRKSGVKSRIQALRQMNETSPENVNYEDQCAYDVADMIKQFFRDLPEPLLTSKLGETFLHIYQYVPKDQRLQAVQSAIMLMSDENREVLQTLLCFLSDVTSVEENQMTPMNLAVCLAPSLFHLNLLKKDNSPRAIQKKYATGRPDQKDLNENFAATQGLAHMIMECNRLFEIPHKVIAQSSNSYEEANVHVQTMEELGKQLEEEGGNVSTYFESTIQGLQKEAKEKFKGWISLSSAENTDLAYKKVGDGNPLRLWKVSVEVEAPPSVVLNHILRERQLWDDDFLQSKVVETLDNQTEVYQYVLNCMAPHPSRDFVVLRSWRTDLPKGICALAAVSVEHDEANLIGGVRAAVLDTRFLIEPCGSGKSKLTHICRVDLKGHSPEWYNKCFGHLCASEALRIRNSFQPISTEGPETKI

SEQ ID NO: 125 - protein, 1191 aa, Homo sapiens
MPGTPGSLEMGLLTFRDVAIEFSPEEWQCLDTAQQNLYRNVMLENYRNLAFLGIALSKPDLITYLEQGKEPWNMKQHEMVDEPTGICPHFPQDFWPEQSMEDSFQKVLLRKYEKCGHENLQLRKGCKSVDECKVHKEGYNKLNQCLTTAQSKVFQCGKYLKVFYKFLNSNRHTIRHTGKKCFKCKKCVKSFCIRLHKTQHKCVYITEKSCKCKECEKTFHWSSTLTNHKEIHTEDKPYKCEECGKAFKQLSTLTTHKIICAKEKIYKCEECGKAFLWSSTLTRHKRIHTGEKPYKCEECGKAFSHSSTLAKHKRIHTGEKPYKCEECGKAFSHSSALAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRFHTREKPFKCKECGKGFIWSSTLTRHKRIHTGEKPYKCEECGKAFRQSSTLTKHKIIHTGEKPYKFEECGKAFRQSLTLNKHKIIHSREKPYKCKECGKAFKQFSTLTTHKIIHAGKKLYKCEECGKAFNHSSSLSTHKIIHTGEKSYKCEECGKAFLWSSTLRRHKRIHTGEKPYKCEECGKAFSHSSALAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRIHTREKPFKCKECGKAFIWSSTLTRHKRIHTGEKPYKCEECGKAFSRSSTLTKHKTIHTGEKPYKCKECGKAFKHSSALAKHKIIHAGEKLYKCEECGKAFNQSSNLTTHKIIHTKEKPSKSEECDKAFIWSSTLTEHKRIHTREKPYKCEECGKAFSQPSHLTTHKRMHTGEKPYKCEECGKAFSQSSTLTTHKIIHTGEKPYKCEECGKAFRKSSTLTEHKIIHTGEKPYKCEECGKAFSQSSTLTRHTRMHTGEKPYKCEECGKAFNRSSKLTTHKIIHTGEKPYKCEECGKAFISSSTLNGHKRIHTREKPYKCEECGKAFSQSSTLTRHKRLHTGEKPYKCGECGKAFKESSALTKHKIIHTGEKPYKCEKCCKAFNQSSILTNHKKIHTITPVIPLLWEAEAGGSRGQEMETILANTVKPLLY

SEQ ID NO: 126 - protein, 613 aa, Xenopus laevis
MGMWEEVSDTGMKKKKDKNEEEEERGKKERMVNLTLEMIYLLTGEHYIPRKKSDDGGALHAPGSVIQKENNKNDKKILELMSNIIQLLTGEVAIRTHHVSIYFSLDEWDYMKGNKDLYEEGIKEEPQQLHPLDCEYEDKRDIPSDLGGTLCYNNETSKIGAEGTDFCAKENLTISPVEQPPPANGIKEERASCEEGNQSDCSINPLTEQIQGTDKPTPIMGYSLNNSSANYIKEEVVQCHEGNHSDMRIITAPESILETNTSAAMIRCNLNTSLSASCEGGNQSDCRINELTEQIPGTDTPTGNIVLYICSECQKHFSTKAGLARHQKTHSVFVGEEHAYGRIHTEEKPFPCSECGKRFARRQHLTDHQSSHTGEKPYACSQCEKYFPHRSNLNRHLKLHKGEKPFPCSQCGKRFPCVSDLNIHRRVHTGERPYSCSECGKCFKHHSNLTNHQRTHTREKPFSCTECGKGFKDRSSLTVHHRTHTGEKPFSCTECGKGFKDRSSLTVHHRTHTGEKPFSCSECGKCFINQACLRVHKRIHTGEKPFPCTECEKSFSDRACLRGHKRTHTGEKPYSCSECGKCFRDGAGLRVHKRIHMGEKPYTCSDWFDLYLY

SEQ ID NO: 127 - protein, 1186 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNSDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKRGIRIAQSKEDKEDQEPIRCPVPGCDGQGHITGKYASHRSASGCPLAAKRQKEGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 128 - protein, 1210 aa, Pan troglodytes
MFPFSSSSFFFYRYVKEAKEATKNGDLEEAFKLFNLAKDIFPNEKVLSRIQKIQEALEELAEQGDDEFTDVCNSGLLLYRELHNQLFEHQKEGIAFLYSLYRDGRKGGILADDMGLGKTVQIIAFLSGMFDASLVNHVLLIMPTNLINTWVKEFIKWTPGMRVKTFHGPSKDERTRNLNRIQQRNGVIITTYQMLINNWQQLSSFRGQEFVWDYVILDEAHKIKTSSTKSAICARAIPASNRLLLTGTPIQNNLQELWSLFDFACQGSLLGTLKTFKMEYENPITRAREKDATPGEKALGFKISENLMAIIKPYFLRRTKEDVQKKKSSNPEDRLNEKNPDVDAICEMPSLSRKNDLIIWIRLVPLQEEIYRKFVSLDHIKELLMETRSPLAELGVLKKLCDHPRLLSARACCLLNLGTFSAQDGNEGEDSPDVDHIDQVTDDTLMEESGKMIFLMDLLKRLRDEGHQTLVFSQSRQILNIIERLLKNRHFKTLRIDGTVTHLLEREKRINLFQQNKDYSVFLLTTQVGGVGLTLTAATRVVIFDPSWNPATDAQAVDRVYRIGQKENVVVYRLITCGTVEEKIYRRQVFKDSLIRQTTGEKKNPFRYFSKQELRELFTIEDLQNSVTQLQLQSLHAAQRKSDIKLDEHIAYLQSLGIAGISDHDLMYTCDLSVKEELDVVEESHYIQQRVQKAQFLVEFESQNKEFLMEQQRTRNEGAWLREPVFPSSTKKKCPKLNKPQPQPSPLLSTHHTQEEDISSKMASVVIDDLPEEGEKQDLSSIKVNVTTLQDGKGTGSADSIATLPKGFGSVQELCTNSSLGMESFNYVLSKSTKADIGPNLDQLKDDEILRHCKPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTSKPSALAQETSLGAPEPLSGEQLVGSPQDKAAEATSDYETLVKRGKELKECGKIQEALNCLVKALDIKSADPEVMLLTLSLYKQLNNN

SEQ ID NO: 129 - protein, 532 aa, Canis familiaris
MANQRPPSFFIEELNIFCQKHRKVLKYNELSKEGPAHNLRFTFQAIIDEREYPEAEGKSKKEARNTAAKLALEILHKENKAVSSLSLPTTDTSEGLGLEGVGNYIGRMNRLAQKEQLSVNYEQWELKDCGPERFHCRCKIGQKEYDIGKGATKQEAKHLAAKFAYEQIQSEQTLMNADSGSWTTSPSDSRNNTLMRSLCASKSPLENNFSPNCNRDNVDNSPSSLSNARYSEKKVKRTLAPTFSSPMTKEHKYTVELRFASDFTEIEPIGSGGYGQVFKAKHKIDGKIYVIKRVKYDSDKKVEREVKALAALDHVNIVHYRSCWAGEDYNPEDSVNPSRTTKCLFIQMEFCDKGTLEQWIDNRRGKEQDKPLALELFEQIVAGVNYIHSKQLIHRDLKPGNIFLVDTKHIKIGDFGLVTSLKDFANRTSNKGTLRYMSPEQISSQEYGKEVDIFALGLILAELLYICPTVSETLKIFKELRAGKFSDVFDAREKQLLQKLLSLEPMKRPNASEILETLKDWKNVAGKKSRTY

SEQ ID NO: 130 - protein, 661 aa, Drosophila melanogaster
MDENAIRAAIFIQKWYRRHQARREMQRRCNWQIFQNLEYASEQDQAELYKFFNDLIKHMPQAAGRKNQYQGSAHVSVLDDKDDLVEEFGDIVNAKIELPIRKNHIDLLIDVFRKKRGNRLHPKYVALILREAAKSLKQLPNISPVSTAVSQQVTVCGDLHGKLDDLLVVLHKNGLPSSSNPYVFNGDFVDRGKRGLEVLLLLLSLYLAFPNAVFLNRGNHEDSVMNARYGFIREVESKYPRNHKRILAFIDEVYRWLPLGSVLNSRVLIVHGGFSDSTSLDLIKSIDRGKYVSILRPPLTDGEPLDKTEWQQIFDIMWSDPQATMGCVPNTLRGAGVWFGPDVTDNFLQRHRLSYVIRSHECKPNGHEFMHDNKIITIFSASNYYAIGSNKGAYIRLNNQLMPHFVQYISAASQTKRLSFKQRMGIVESSALKELAVRMRDHRDELEDEFRKYDPKDSGYISISHWCKVMENVTKLGLPWRLLRDKLAPGTDSQKVNYNRTLDLLDTDVILEAEADGMSVMDALYANKASLVAIFNIIDADNSGEITLDEFETAIDLLVAHMPGAYSKAEMLEKCRMMDLNGDGKVDLNEFLEAFRLSDLHRKEQQDENIRRRSTGRPSVAKTATDPVTLLADKISKNTLVVEHDIDPTDCESKVIDPKKS

SEQ ID NO: 131 - protein, 1082 aa, Caenorhabditis elegans
MSSSGLDEIDLNSLRDPAGIFELIEVVGNGTYGQVYKGRHVKTAQLAAIKIMNINEDEEDEIKLEINMLKKHSHHRNVATYYGAFIKKLPSSTGKHDQLWLVMEFCGSGSITDLVKNTKGGSLKEEWIAYICREILRGLYHLHQSKVIHRDIKGQNVLLTDSAEVKLVDFGVSAQLDKTVGRRNTFIGTPYWMAPEVIACDESPEATYDSRSDLWSLGITALEMAEGHPPLCDMHPMRALFLIPRNPPPKLKRNKKWTKKFETFIETVLVKDYHQRPYTGALLRHPFIKEQPHEQTIRHSIKEHIDRNRRVKKDDADYEYSGSEDDEPSPNNRGPSMGIRDDSESSSMIPMDNTLRKGFQKLQESSRGFAEPGAQQLRRLPQQPAPAPFQYQQSRYVEPRRESSEVKLRAVSSRGAADGPRHSPASRPRPRSPQQSHPAAPHLADLANYEKRRRSEREERRERERQAHHAMPIARVSASVPAPQQSRKMSEPLLITHVKPEDLDVLASELSKMGGHHNGRSREESMSPPPPAPPPREASISSITDTIDVGELDNGADAEWDDLKDIMMNGEGTLRGPNKPLPPTPTDGENTLVSDVRRNGNGNSGHGAYKGKKIPEIRPGIISLDDDDSDSDNEEGNEPLMFKPINASSSRGALPDLLPKSPQLRRQINDQTRQMSDDRADEQPNGFQNSDSRSSIQHSFSNRDREKSFVGYFGGGAGAGGGTVNRPGRPQDINQVQVNVTPNSNGTPAENDAPEIRKYKKKFSGEILCAALWGVNLLIGTDSGLMLLDRSGQGKVYPLISRRRFDQMTVLEGQNILATISGRKRRIRVYYLSWLRQKILRTEGAGSANTTEKRNGWVNVGDLQGAIHFKIVRYERIKFLVVGLESSIEIYAWAPKPYHKFMSFKSFGSLSHVPLIVDLTVEDNARLKVLYGSTGGFHAIDLDSAAVYDIYTPAQSGQTTTPHCIVVLPNSNGMQLLLCYDNEGVYVNTYGRMTKNVVLQWGEMPSSVAYISTGQIMGWGNKAIEIRSVDTGHLDGVFMHKKAQKLKFLCERNDKVFFSSAKGGGSCQIYFMTLNKPGLTNW

SEQ ID NO: 132 - protein, 486 aa, Danio rerio
MDSAERPLRIPPEMVIYAEKHDIFHLIQTLVRNLMVDKPDDPIQYLINFLERDNVDVPRIILLGPPASGKRTVAKKLCEHTQAIHITFSDILKDDSDLTRAAQSYYDKKQNVPKDLWIQLIQQHLSKPDCVQRGWVLEAIPKTQDEALCLQEAGITPDHVVMLEAPDVVLIERSSGKRIDPVTGDVYHVTFMWPESEEVARRLETPRTLMPVQVMSQKLQKYHTEAHALKRTYHNCLKIINADQPHVDVFSQVLNFICTPRHSPSPYTPRILLFGPPGAGKSLQAKLIAQKYGIINICCGELLKAVSADESHMGELIKPYLESEQQVPSSIVLRVLTERLSRMDCTARGWVLHGFPRDVEEAELLHKSNFTPNRVFFLEITDDIAIERLALRAVDPVTGEWYHSVYKPPPGPEVQARLRFNPQHSEAQLLMRLKEYWSQTVRLQAFYPQAVYINADQDPHTVFESLESRLVGQLPKVLSNQQTNEN

SEQ ID NO: 133 - protein, 1192 aa, Bos taurus
MDEETRHSLECIQANQIFPRKQLIREDENLQVPFLELHGESTEYVGRAEDAIIALSNYRLHIKFKESLVNIPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYRLCGSYPQELIVPAWITDKELESVAGFRSWKRIPAVVYRHQSNGAVIARCGQPEVSWWGWRNADDEHLVQSVAKACASDSRSGGSKPSARNSPRDFPCAGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDRDQRPVLAHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPSTPVDDSCAPYPAPGCSPDDPPLSRLPKTRSFDNLTTACDNTVPLASRRSSDPSLNEKWQEHRRSLELSTLAGPGEEPVEPDSLGKPTKVLGGAELSVAAGVAEGQMENILQEATKEESGVEEPAHRGVQEVKEEALLEEGSRGKSPEGSARELDQQPEVGEASLRSHPGTSLSGLSQGVPEQGGHSVLPSSLQEPPREEGSQEVPMEPSQIGATAEDREEAVLPVSADVAVDSGTSQSSSLPSQVSFETRGPNMDGSVDMLMEDKVKSDSGPQGHHRPGPVHSGWLGGKDVLPPAVEPRPAERPQLGPVVHRTSPGSARSPAHSPSALPLAECKEGLVCNGAPETENKASEQPPGLSTLQKYPTPNGHCANGETGRSKDSLSRQLSATSCSSAHVHTRSLHPKWLHGHSGRPSAAGSPEQPSRSHLDDDGMPVYTDTIQQRLRQIESGHQQEVETLKKQVQELRSRLESQYLTSSLRFNGDFGDEVTSIPDSESNLDQNCLSRCSTEIFSEASWEQVDKQDTEMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 134 - protein, 342 aa, Bos taurus
MEEAARAGKAAMEPESLYNLLHLPGKEDPPAEEELSQGEKRKFLPPTSRNNPKFEELQKVLMDWINAELLPEHIVVRSLEEDIFDGLILHHLFQKLSGLKLDVEEIALTAASQRRKLAAVLESVDQSLQLEEPQAKWSMESIFNKDLLATLHLLVALAKRFQPDLPLPTNVQVEVITMERTKSGLKSEKSVEQLTECGADKDQPSKDVFDELFKLAPEKVNAVKEAIVKFVNQELDRLGLSVQNLDTQFADGVILLLLIGQLEGFFLHLKEFYLTPSSPAEMLHNVTLALELLKEEGLLSYPVNPEDIVNKDAKSTLRVLYSLFRKHKLKESTDGVPQRSPN

SEQ ID NO: 135 - protein, 1849 aa, Homo sapiens
MARLADYFIVVGYDHEKPGSGEGLGKIIQRFPQKDWDDTPFPQGIELFCQPGGWQLSRERKQPTFFVVVLTDIDSDRHYCSCLTFYEAEINLQGTKKEEIEGEAKVSGLIQPAEVFAPKSLVLVSRLYYPEIFRACLGLIYTVYVDSLNVSLESLIANLCACLVPAAGGSQKLFSLGAGDRQLIQTPLHDSLPITGTSVALLFQQLGIQNVLSLFCAVLTENKVLFHSASFQRLSDACRALESLMFPLKYSYPYIPILPAQLLEVLSSPTPFIIGVHSVFKTDVHELLDVIIADLDGGTIKIPECIHLSSLPEPLLHQTQSALSLILHPDLEVADHAFPPPRTALSHSKMLDKEVRAVFLRLFAQLFQGYRSCLQLIRIHAEPVIHFHKTAFLGQRGLVENDFLTKVLSGMAFAGFVSERGPPYRSCDLFDELVAFEVERIKVEENNPVKMIKHVRELAEQLFKNENPNPHMAFQKVPRPTEGSHLRVHILPFPEINEARVQELIQENVAKNQNAPPATRIEKKCVVPAGPPVVSIMDKVTTVFNSAQRLEVVRNCISFIFENKILETEKTLPAALRALKGKAARQCLTDELGLHVQQNRAILDHQQFDYIIRMMNCTLQDCSSLEEYNIAAALLPLTSAFYRKLAPGVSQFAYTCVQDHPIWTNQQFWETTFYNAVQEQVRSLYLSAKEDNHAPHLKQKDKLPDDHYQEKTAMDLAAEQLRLWPTLSKSTQQELVQHEESTVFSQAIHFANLMVNLLVPLDTSKNKLLRTSAPGDWESGSNSIVTNSIAGSVAESYDTESGFEDSENTDIANSVVRFITRFIDKVCTESGVTQDHIKSLHCMIPGIVAMHIETLEAVHRESRRLPPIQKPKILRPALLPGEEIVCEGLRVLLDPDGREEATGGLLGGPQLLPAEGALFLTTYRILFRGTPHDQLVGEQTVVRSFPIASITKEKKITMQNQLQQNMQEGLQITSASFQLIKVAFDEEVSPEVVEIFKKQLMKFRYPQSIFSTFAFAAGQTTPQIILPKQKEKNTSFRTFSKTIVKGAKRAGKMTIGRQYLLKKKTGTIVEERVNRPGWNEDDDVSVSDESELPTSTTLKASEKSTMEQLVEKACFRDYQRLGLGTISGSSSRSRPEYFRITASNRMYSLCRSYPGLLVVPQAVQDSSLPRVARCYRHNRLPVVCWKNSRSGTLLLRSGGFHGKGVVGLFKSQNSPQAAPTSSLESSSSIEQEKYLQALLNAVSVHQKLRGNSTLTVRPAFALSPGVWASLRSSTRLISSPTSFIDVGARLAGKDHSASFSNSSYLQNQLLKRQAALYIFGEKSQLRNFKVEFALNCEFVPVEFHEIRQVKASFKKLMRACIPSTIPTDSEVTFLKALGDSEWFPQLHRIMQLAVVVSEVLENGSSVLVCLEEGWDITAQVTSLVQLLSDPFYRTLEGFQMLVEKEWLSFGHKFSQRSSLTLNCQGSGFAPVFLQFLDCVHQVHNQYPTEFEFNLYYLKFLAFHYVSNRFKTFLLDSDYERLEHGTLFDDKGEKHAKKGVCIWECIDRMHKRSPIFFNYLYSPLEIEALKPNVNVSSLKKWDYYIEETLSTGPSYDWMMLTPKHFPSEDSDLAGEAGPRSQRRTVWPCYDDVSCTQPDALTSLFSEIEKLEHKLNQAPEKWQQLWERVTVDLKEEPRTDRSQRHLSRSPGIVSTNLPSYQKRSLLHLPDSSMGEEQNSSISPSNGVERRAATLYSQYTSKNDENRSFEGTLYKRGALLKGWKPRWFVLDVTKHQLRYYDSGEDTSCKGHIDLAEVEMVIPAGPSMGAPKHTSDKAFFDLKTSKRVYNFCAQDGQSAQQWMDKIQSCISDA

SEQ ID NO: 136 - protein, 1890 aa, Rattus norvegicus
MAETEPTIKKEARIVSAVAGIVVGKGMFGLKLKKKKKDKTEKGLVLTNKGAQDGSESEVPQEGPSHQEGPEDLTYDDASITPGPSAPSKRRAKLLTKIHDGEVKSQNYQITITITEARQLVGENIDPVVTIEIGDEKKQSTVKEGTNSPFYNEYFVFDFIGPQVHLFDKIIKISVLHHKLIGSILIGSFRVDVGTVYNQPGHQFCDKWALLTDPGDIRTGTKGYLKCDISVTGKGDILKTNPKTSDAEEQIEKNLLIPQGFPSERPWARFYVRLYRAEGLPKMNSSIMANVTKAFVGDSKDLVDPFVEVSFAGQTGRTSVQKNCADPVWHEQVVFKEMFPPLCRRVKIQLWDEGSMNDVTLATHFIDLKKISNEQDGDKGFLPTFGPAWINLYGSPRNHSLMDDYQELNEGFGEGVSFRGRILVEIAVEILSGGAQESKFSKALKELKLSSKDKDSKSSKGSSKDKADKADDGKAQQATDKTNSTEVEVESFAVPPEIIPEKYEDFLLFGAFFEATMIDRKIGDKPISFEVSVGNFGNLIDGGSHHGSKKKSAELMEEDVLPLLHEGEKDVAHDTAISMASTTHPEKPLVTDGNRNYNYLPFGAKKPCVSFISSWGDQIFRLHWSNMLEKMADLLEEGIEEVRELVKVSEEAPEEKMKTVLHDFISQSRAFISEAEKKQKTPNQTALDKKRLTLCWQELKAMTDEAEGVIQQQKKKLSLDEMIREAQNFVEKIRFLVDEPQHTIPDVFIWMLSNNKRVAYARIAAKDLLYSPIEEQMGKHCGKIKTHFLKLPGKRPAGWTVQAKVDIYLWLGSTRYSDAVLDNLPAGYEAEMPSKSSGTHHPPSALLYQAQHVFQLRAHMYQARGLIAADSNGLSDPFAKVTFLSQCQTTKVISQTLSPTWNQMLLFNELVLHGEERELMESPPLVVVELYDSDAVGKPEYLGATVAAPVVTLADQDYEPPKLCYHPIFCGNLSGGDLLAVFELLQVPSSGLQGLPPTGPPDITQIYPVPSNIRPVLSKYRVEVLFWGVREMKKVQLLSVDRPQVLIECGGRGVKSCVIQSYKNNPNFSVQAEAFEVELPENELLHPPLSICVVDWRAFGRSTLVGTYTINCLKQFLCKSREPLALTSQTDGAGARPAISDSPAAVQSSELLSSSKDLPTDHVYVDIEPPPTEVPDSAQAQTATLVDMPDSSPMLEPEHKPVAQGLPKDGHIKQDPRMPSRRSTKRRRRTIADESAENVIDWWSKYYASVKKAQKVESPLPVTVKGSTEAKPGEVVLDVDDGPKKKKDKMFKKKLKDDGNEAIPNLAVLKIYDGDLESEFNNFEDWVKTFELFRGKSTEDDHSLDGDRVIGKFKGSFCIYKSPEDSASEDSGQLRIQQGIPPNHPIQVLIRVYIVAAFNLSPADPDGKSDPYIVLRLGQTEIKDRDKYIPKQLNPVFGRSFEIQATFPKESLLSVLIYDHDMIGSDDLIGETKIDLENRFYSKHRAICGLQSQYEIEGYNAWRDTAKPTEILTKLCKDNMLDGPHFRPGKIQIGKKVFSGKTVFTEADSEEMVESYEHLALKVLHSWEDIPEVGCRLVPEHIETRPLYHKDKPGMEQGRLQMWVDIFPKDTPQLGPPVDISPRKPKGYELRVTIWNTEDVILEDENIFTGQKSSDIYVKGWIKGLEDDRQETDVHYNSLTGEGNFNWRFLFPFQYLPAEKQMVISKRENIFSLEKMECKTPAVLVLQVWDFERLSSDDFLGSLEMNLNSFPRAAKSAKACDLSKFENASEENKISIFQQKRVRGWWPFAKSKELTGKVEAEFHLVTAEEAEKNPVGKARKEPEPLAKPNRPDTSFSWFVSPFKCLYHLIWKNYKKYIIIAFILIILIVFLVLFIYTLPGAISRRIVVGGS

SEQ ID NO: 137 - protein, 2787 aa, Canis familiaris
MLGVPTSLGALALGARRIYCGTLQAFRGLDAQMLGSSIQPGALTGDICPCVSKRAEWGPQGQSGRAGSPDTGSIALGLMDVSEPGTKDRFTAAGRPAPAGVRSAPARVRGPARPSEGRRLVLASRPSACEAPGQQGKSGPSGPAGPGGGASRSRGGAAGGGRAQAQARGQRSGAARRGAQTPDAPRGSRLRGAHPRGTARQAKPGECAERRRSGGGRLRTLRPEPAPQTRAPGAGERRRAMATTNLAVENGQPDRKPPALPRPVRSLEVEFTKIFINNEWHESKSGKKFATYNPSTLEKICEVEEGDKLDVDKAVEAAHAAFQRGSPWRRLDALGRGWLLHQLADLVERDRAILATLETMDTGKPFLHAFFIDLEGCIKTLRYFAGWADKIQGRTIPTDDNVVCFTRHEPIGVCGAITPWNFPLLMLVWKLAPALCCGNTIVVKPAEQTPLTALYLGSLIKEVGFPPGVVNIVPGFGPTVGAAISSHPHISKIAFTGSTEVGKLVKEAASRSNLKRVTLELGGKNPCIVCADADLDLAVECAHQGVFFNQGQCCTAASRVFVEEQIYPEFVRRSVEYAKKRPIGDPFDIRTEQGPQIDQKQFDKILDLIESGKKEGAKLECGGSAMEDRGLFIKPTVFSEVTDTMRIAKEEIFGPVQPILKFKNIEEVIKRANSLEYGLTAAVFTKNLDKALKLASALESGTVWINCYNAIYAQAPFGGFKMSGNGRELLDMFHEVGGSLSFHCLHLMDVSRQMECEEECRKEEKEYQATQELMAGMSRRPPSMYWCVGPEGSAVCPKRAMETRNGAEDMGSKPSTPGSDPTTQCPGTEGIHAAYKQGDPSRARHLLREACDESTSQLEKGRLLSISAAYGDLETVRYLLTERRVELPTEPTDDNPAVVAAHFGHTDVVQELLESLPGPCSPQRLLNWMLALACQQGHLGLVKLLVLTHGADPESYAVRKNEFPVIVRLPLYAAIKSGNEDIAIFLLRHGAFFCSYILLDSPDPSKHLLRKYFIEASALASSCPGKMALRVKWSHLKLPWVDLDWLIDISCQITELDLSANCLASLPSVIPWGLINLRKLNLSKNHLGELPAVQSSDEIICSRLLEIDVSSNKLPHLPPGFLHLSKLQKLTASKNYLEKLFEEESATNWIGLRKLQELDISDNKLTELPALFLHSFKSLSFLNVSRNNLKVFPDAWACPLKCCKASKNALESLPDKMAVFWKNHLRDVDFSENALKEVPLGLLQLDTLMSLRLQGNQLMALPPQEKWTCRQLKTLDLSKNQFGKTEDGMKTKRISFFTTRGRQRSGTETVGVLEFPAFLSESLEVLCLNDNHLDSVPPSVCLLKSLSELYLGNNPGLRELPPELGQLSNLWQLDIEDLNISNVPTEIKKEGPKAMLSYLRAQLRKAEKCKLMKMIIVGPPRQGKSTLLEILQTGRAPQVVHSEATIRTTKWELQRPAGSRAKVDSVEFTVWDIGGPASMATVNQCFFTDKALYVVVWNLALGEEAVASLQFWLLNIEAKAPNAVVLVVGTHLDLIETKFRVERIATLRAYVLALCRSPSGSRATGFPDITFKHLHELSCKSLEGHEGLRQLIFHVTCNMKDVGSTIGCQRLAGRLIPRSYLSLQEAVLAEQQRRSLSDDVQYLTDRQLEQLVEQMPDNDIKDYEDLQSAISFLIETGTLLHFPDTSHGLRNLYFLDPIWLSECLQRIFNIKGSRSVAKNGVIRAEDLRMLLVGTGFTQQTEEQYFQFLAKFEIALPVANDSYLLPHLLPSKPGLDTHGMQHPKANTIQRVFKMSFVPVGFWQRFIARMLISLAEMDLQLFENKKNTKSRHRKVTIYSFTGSQRNRCSTFRVKRNQTIYWQEGLLVTFDGGYLSVESSDVNWKKKKSGGIKIICQSEMRDFSAMAFITDHVNSLIDQWFPALTATESDGTPLMEQYVPCPVCETSWAQHTDPSEKSEGVQYFDMEDCVLTAIEQDFISCPRHPDLPVPLQELVPELFMTDFPARLFLENSKLEHNEDESSVLGQGGSGTIIYRARYQGQPVAVKRFQIKKFKNLANTPADTMLRHLRATDAMKNFSEFRQEASMLHALQHPCIVSLIGISIHPLCFALELAPLGSLNTVLSENAKDSSFMPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPILGQPEEVQFHRLQALMMECWDTKPEKRPLALSVVSQMKDPTFATFMYQLPCGKQTAFFSSQGQEYMVVFWDGKEESRNYTVVNTEKGLMEVQRMSCAGMKLSCQLKVQNSLWTATEDQKIYIYSLKGMCPLNTPQRALDTPAVVTCLLAVPIIKKNSYLVLAGLDDGLVAVFAVVRGVPDNSCSYLCSHTANRSKFSIPDEDMRQNPYPVKAMEVVNSGSEVWYSNGPGLLVIDCAALEISRRLEPYLAPSVVTSLVCSSECRGEEVVWCLDNRANLLVMYHAATYQLCARYFCGDPSPLRDMFPVRPLGPESPGRHMASPKEPEGDSIADVSIMYSEELGTQILTHQDSLTDYCSMSSYSSSSPHRAPASSSSLPCSPASSSSVPFSTDCEDSDRLHEPTAGSDRSEHDLTPVDGEAFSQHLQAVRILAVKDVIWVPRRGGDVIVIGLEKDASGQRGRVIAVLKARELTPRGVLMDAAVVAKDTVVCGFENENMEWCLAVWRGWGTREFDVFYQSYEELGRLEACMRKRR

SEQ ID NO: 138 - protein, 887 aa, Xenopus laevis
MGIVAETSQNGDTSLCSEKKFTVPQPPSIEEFGIVKPISRGAFGKVYLARRKNNSKLFAVKVVKKADMINKNMVQQVQAERDALALSKSPFIVHLYYSLQSANNIYLVMEYLIGGDVKSLLHIYGYFDEEMAVKYISEVAMALDYLHRHGIIHRDLKPDNMLISNKGHIKLTDFGLSKVTLKRELCMMDILTTPSMAKPKRDYSRTPGQVLSLISSLGFNTPAGGRTQGSLNQQTEGMRGNASTPLLMKKRESLVKGNKLMISCPEASLSSPSIPVKCLTPNLLKCRTQFATSSTSSQSRICLSSLESECGSPRWENCSQDAEAPPYFNSSRVKDSSSEQARSKKPTGSSASQNLKRLEFAFSPIVDRRTGKKAGFQDETGELSDTPLATLNAKGVIRKCLYENKAQEKPKDFDKTGQGELGKFTSSPDSPPWLANGSVAPIQFNDEEKTEKMGVKRNYDLVEKSPEQELLQDKKTNTDYKRGCAITDYPVSQSTGLTMEINSLFLSELRNSANKYASDRKSEDKYISAPRTLEKLDSGNPVAKNLLCELDDNCERDGEVSSTSEGEDRKERLNQDSSSTGMSVTENQIDRDLSHVDKSIKELSFEESQSENSEEITPDNKGIPFMAENDERVQSKYEPNTSILPDSLQNVLASPAPASAMTNPRRKPMVAFRSYNSPINVSNVSEPSKISMNSADKIHFSLECTGSFPMAVTPAQNKVQGLIETPYRTPKSVRRGGIQVDHERILGTPDYLAPELLLRKSHGPAVDWWALGVCLFEFLTGIPPFNDETPSQVFQNILNRDIPWPEEEEEVLSVNAQSAIEILLTIDPTKRAGLKDLKAHPLFHGMEWEELQYQPMSFIPQPDDETDTTYFEARNNAQHLKVSGFSL

SEQ ID NO: 139 - protein, 367 aa, Homo sapiens
MGTVLSLSPASSAKGRRPGGLPEEKKKAPPAGDEALGGYGAPPVGKGGKGESRLKRPSVLISALTWKRLVAASAKKKKGSKKVTPKPASTGPDPLVQQRNRENLLRKGRDPPDGGGTAKPLAVPVPTVPAAAATCEPPSGGSAAAQPPGSGGGKPPPPPPPAPQVAPPVPGGSPRRVIVQASTGELLRCLGDFVCRRCYRLKELSPGELVGWFRGVDRSLLLQGWQDQAFITPANLVFVYLLCRESLRGDELASAAELQAAFLTCLYLAYSYMGNEISYPLKPFLVEPDKERFWQRCLRLIQRLSPQMLRLNADPHFFTQVFQDLKNEGEAAASGGGPPSGGAPAASSAARDSCAAGTKHWTMNLDR

SEQ ID NO: 140 - protein, 424 aa, Homo sapiens
MGCGTSKVLPEPPKDVQLDLVKKVEPFSGTKSDVYKHFITEVDSVGPVKAGFPAASQYAHPCPGPPTAGHTEPPSEPPRRARVAKYRAKFDPRVTAKYDIKALIGRGSFSRVVRVEHRATRQPYAIKMIETKYREGREVCESELRVLRRVRHANIIQLVEVFETQERVYMVMELATGGELFDRIIAKGSFTERDATRVLQMVLDGVRYLHALGITHRDLKPENLLYYHPGTDSKIIITDFGLASARKKGDDCLMKTTCGTPEYIAPEVLVRKPYTNSVDMWALGVIAYILLSGTMPFEDDNRTRLYRQILRGKYSYSGEPWPSVSNLAKDFIDRLLTVDPGARMTALQALRHPWVVSMAASSSMKNLHRSISQNLLKRASSRCQSTKSAQSTRSSRSTRSNKSRRVRERELRELNLRYQQQYNG

SEQ ID NO: 141 - protein, 756 aa, Homo sapiens
  misc_feature (84)..(84): Xaa can be any naturally occurring amino acid
MSWSPSLTTQTCGAWEMKERLGTGGFGNVIRWHNQETGEQIAIKQCRQELSPRNRERWCLEIQIMRRLTHPNVVAARDVPEGMXNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 142 - protein, 831 aa, Homo sapiens
MKIPNIGNVMNKFEILGVVGEGAYGVVLKCRHKETHEIVAIKKFKDSEENEEVKETTLRELKMLRTLKQENIVELKEAFRRRGKLYLVFEYVEKNMLELLEEMPNGVPPEKVKSYIYQLIKAIHWCHKNDIVHRDIKPENLLISHNDVLKLCDFGFARNLSEGNNANYTEYVATRWYRSPELLLGAPYGKSVDMWSVGCILGELSDGQPLFPGESEIDQLFTIQKVLGPLPSEQMKLFYSNPRFHGLRFPAVNHPQSLERRYLGILNSVLLDLMKNLLKLDPADRYLTEQCLNHPTFQTQRLLDRSPSRSAKRKPYHVESSTLSNRNQAGKSTALQSHHRSNSKDIQNLSVGLPRADEGLPANESFLNGNLAGASLSPLHTKTYQASSQPGSTSKDLTNNNIPHLLSPKEAKSKTEFDFNIDPKPSEGPGTKYLKSNSRSQQNRHSFMESSQSKAGTLQPNEKQSRHSYIDTIPQSSRSPSYRTKAKSHGALSDSKSVSNLSEARAQIAEPSTSRYFPSSCLDLNSPTSPTPTRHSDTRTLLSPSGRNNRNEGTLDSRRTTTRHSKTMEELKLPEHMDSSHSHSLSAPHESFSYGLGYTSPFSSQQRPHRHSMYVTRDKVRAKGLDGSLSIGQGMAARANSLQLLSPQPGEQLPPEMTVARSSVKETSREGTSSFHTRQKSEGGVYHDPHSDDGTAPKENRHLYNDPVPRRVGSLYRVPSPRPDNSFHENNVSTRVSSLPSESSSGTNHSKRQPAFDPWKSPENISHSEQLKEKEKQGFFRSMKKKKKKSQTVPNSDSPDLLTLQKSIHSASTPSSRPKEWRPEKISDLQT

SEQ ID NO: 143 - protein, 212 aa, Homo sapiens
MEISMPPPQIYVEKTLAIIKPDIVDKEEEIQDIILRSGFTIVQRRKLRLSPEQCSNFYVEKYGKMFFPNLTAYMSSGPLVAMILARHKAISYWLELLGPNNSLVAKETHPDSLRAIYGTDDLRNALHGSNDFAAAEREIRFMFPEVIVEPIPIGQAAKDYLNLHIMPTLLEGLTELCKQKPADPLIWLADWLLKNNPNKPKLCHHPIVEEPY

SEQ ID NO: 144 - protein, 528 aa, Homo sapiens
MQGPWVLLLLGLRLQLSLGVIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAHPVAASLPLLAGTLLLLGASAAP

SEQ ID NO: 145 - protein, 1038 aa, Homo sapiens
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANRTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 146 - protein, 467 aa, Homo sapiens
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 147 - protein, 494 aa, Xenopus tropicalis
MEQYNIVRVIGEGSFGRALLVCHKSSNHKYVMKEIRLPKSFHAMEDSRKEAVLLANMKHSNIVTFQESFEGDGHLYIVMEYCQGGDLLQKIKLQKGRLFTEQTILQWFVQICLAVQYIHEKRVLHRDIKSKNIFLTQSCNIKLGDFGSARILTSPAAYACTYVGTPYYVPPEIWENMPYNNKSDIWSLGCVLYELCTLKHPFQAGSWKNLILKICQGSYKPLPLQYSYELRSLINQMFRKNPRSRPSASTILSRTALSKLIRTAPSPKISVGQSPENQGTRNVVATHEPSPQVFDSRYEAETSSPGLQRKQWKKEMSHTVLNNLENASILTTSTAAGNCSETDPNSQELQRKQWNKEPSDTLLNKLENASILPSSIAAGNSSGCISNYDVNDKRKKWKKEFPETLINFLQNADLSLAFKTYTIYKAKATEDCLRGPLDSDSQAPDVTDSIEAEVAVDTERFQLRSDDEDTDFEEEDTDPDWISELEKLTHSPNF

SEQ ID NO: 148 - protein, 942 aa, Homo sapiens
MASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDISNFDEEFTGEAPTLSPPRDARPLTAAEQAAFLDFDFVAGGC

SEQ ID NO: 149 - protein, 946 aa, Rattus norvegicus
MAGDAVQSEPRSWSLLEQLGLAGADLAAPGVQQQLELERERLKREIRKELKLKEGAENLRRATTDLGRSLAPVELLLRGSARRLDLLHQQLQELHAHVVLPDPTAGSDAPQSLAEGSPVCSSTNLSRVAGLEKQLAIELKVKQGAENMIQTYSNGSTKDRKLLLTAQQMLQDSKTKIDIIRMQLRRALQALQAGQLESQAAPDEAHGDPDLGAVELRIEELRHHFRVEHAVAEGAKNVLRLLSAAKAPDRKAVSEAQEKLTESNQKLGLLRESLERRLGELPADHPKGRLLREELTAASSAAFSAILPGPFPATHYSTLSKPAPLTGTLEVRVVGCKNLPETIPWSPPPSVGASGTPDSRTPFLSRPARGLYNRSGSLSGRSSLKGEAENSTEVSTVLKLDNTVVGQTAWKPCGPNAWDQSFTLELERARELELAVFWRDQRGLCALKFLKLEDFLDNERHEVQLDMEPQGCLVAEVTFRNPIIERIPRLQRQKKIFSKQQGQTFQRARQMNIDVATWVRLLRRLIPNAVATGSFSPNASPGSEIRSTGDISMEKLNLGADSDSSSQKSPAGLPSTSCSLSSPTHESTTSPELPSETQETPGPGLCSPLRKSPLTLEDFKFLAVLGRGHFGKVLLSEFHSSGELFAIKALKKGDIVARDEVESLMCEKRILATVTRAGHPFLVNLFGCFQTPEHVCFVMEYSAGGDLMLHIHSDVFSEPRAVFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSTERDAEDVKKQPFFRTLDWDALLARRLPPPFVPTLSGRTDVSNFDEEFTGEAPTLSPPRDARPLTAAEQAAFRDFDFVAGGY

SEQ ID NO: 150 - protein, 3223 aa, Homo sapiens
MQKARGTRGEDAGTRAPPSPGVPPKRAKVGPAAGAPVAVAGAPVFLRPLKNAAVCAGSDVRLRVVVSGTPHPILRWFRDGQLLPAPAPEPSCLWLRRCGAQDAGVYSCMAQNERGRASCEAVLTVLEVGDSETAEDDISDVQGTQRLELRDDGAFSTPTGGSDTLVGTSLDTPPTSVTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGEGPQQEVRRRDQFPLTRSRAIQECRSPVPPPAADPPEARTKAPPGRKREPPAQAVRFLPWATPGLEGAAVPQTLEKNRAGPEAEKRLRRGPEEDGPWGPWDRRGARSQGKGRRARPTSPELESSDDSYVSAGEEPLEAPVFEIPLQNVVVAPGADVLLKCIITANPPPQVSWHKDGSALRSEGRLLLRAEGERHTLLLREARAADAGSYMATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRAHPESRSLAVLAPLQDVDVGAGEMALFECLVAGPTDVEVDWLCRGRLLQPALLKCKMHFDGRKCKLLLTSVHEDDSGVYTCKLSTAKDELTCSARLTVRPSLAPLFTRLLEDVEVLEGRAARFDCKISGTPPPVVTWTHFGCPMEESENLRLRQDGGLHSLHIAHVGSEDEGLYAVSAVNTHGQAHCSAQLYVEEPRTAASGPSSKLEKMPSIPEEPEQGELERLSIPDFLRPLQDLEVGLAKEAMLECQVTGLPYPTISWFHNGHRIQSSDDRRMTQYRDVHRLVFPAVGPQHAGVYKSVIANKLGKAACYAHLYVTDVVPGPPDGAPQVVAVTGRMVTLTWNPPRSLDMAIDPDSLTYTVQHQVLGSDQWTALVTGLREPGWAATGLRKGVQHIFRVLSTTVKSSSKPSPPSEPVQLLEHGPTLEEAPAMLDKPDIVYVVEGQPASVTVTFNHVEAQVVWRSCRGALLEARAGVYELSQPDDDQYCLRICRVSRRDMGALTCTARNRHGTQTCSVTLELAEAPRFESIMEDVEVGAGETARFAVVVEGKPLPDIMWYKDEVLLTESSHVSFVYEENECSLVVLSTGAQDGGVYTCTAQNLAGEVSCKAELAVHSAQTAMEVEGVGEDEDHRGRRLSDFYDIHQEIGRGAFSYLRRIVERSSGLEFAAKFIPSQAKPKASARREARLLARLQHDCVLYFHEAFERRRGLVIVTELCTEELLERIARKPTVCESEIRAYMRQVLEGIHYLHQSHVLHLDVKPENLLVWDGAAGEQQVRICDFGNAQELTPGEPQYCQYGTPEFVAPEIVNQSPVSGVTDIWPVGVVAFLCLTGISPFVGENDRTTLMNIRNYNVAFEETTFLSLSREARGFLIKVLVQDRLRPTAEETLEHPWFKTQAKGAEVSTDHLKLFLSRRRWQRSQISYKCHLVLRPIPELLRAPPERVWVTMPRRPPPSGGLSSSSDSEEEELEELPSVPRPLQPEFSGSRVSLTDIPTEDEALGTPETGAATPMDWQEQGRAPSQDQEAPSPEALPSPGQEPAAGASPRRGELRRGSSAESALPRAGPRELGRGLHKAASVELPQRRSPGPGATRLARGGLGEGEYAQRLQALRQRLLRGGPEDGKVSGLRGPLLESLGGRARDPRMARAASSEAAPHHQPPLENRGLQKSSSFSQGEAEPRGRHRRAGAPLEIPVARLGARRLQESPSLSALSEAQPSSPARPSAPKPSTPKSAEPSATTPSDAPQPPAPQPAQDKAPEPRPEPVRASKPAPPPQALQTLALPLTPYAQIIQSLQLSGHAQGPSQGPAAPPSEPKPHAAVFARVASPPPGAPEKRVPSAGGPPVLAEKARVPTVPPRPGSSLSSSIENLESEAVFEAKFKRSRESPLSLGLRLLSRSRSEERGPFRGAEEEDGIYRPSPAGTPLELVRRPERSRSVQDLRAVGEPGLVRRLSLSLSQRLRRTPPAQRHPAWEARGGDGESSEGGSSARGSPVLAMRRRLSFTLERLSSRLQRSGSSEDSGGASGRSTPLFGRLRRATSEGESLRRLGLPHNQLAAQAGATTPSAESLGSEASATSGSSAPGESRSRLRWGFSRPRKDKGLSPPNLSASVQEELGHQYVRSESDFPPVFHIKLKDQVLLEGEAATLLCLPAACPAPHISWMKDKKSLRSEPSVIIVSCKDGRQLLSIPRAGKRHAGLYECSATNVLGSITSSCTVAVARVPGKLAPPEVTQTYQDTALVLWKPGDSRAPCTYTLERRVDGESVWHPVSSGIPDCYYNVTHLPVGVTVRFRVACANRAGQGPFSNSSEKVFVRGTQDSSAVPSAAHQEAPVTSRPARARPPDSPTSLAPPLAPAAPTPPSVTVSPSSPPTPPSQALSSLKAVGPPPQTPPRRHRGLQAARPAEPTLPSTHVTPSEPKPFVLDTGTPIPASTPQGVKPVSSSTPVYVVTSFVSAPPAPEPPAPEPPPEPTKVTVQSLSPAKEVVSSPGSSPRSSPRPEGTTLRQGPPQKPYTFLEEKARGRFGVVRACRENATGRTFVAKIVPYAAEGKPRVLQEYEVLRTLHHERIMSLHEAYITPRYLVLIAESCGNRELLCGLSDRFRYSEDDVATYMVQLLQGLDYLHGHHVLHLDIKPDNLLLAPDNALKIVDFGSAQPYNPQALRPLGHRTGTLEFMAPEMVKGEPIGSATDIWGAGVLTYIMLSGRSPFYEPDPQETEARIVGGRFDAFQLYPNTSQSATLFLRKVLSVHPWSRPSSCLSVCHKEIKMASS

SEQ ID NO: 151 - protein, 993 aa, Homo sapiens [sequence omitted]

SEQ ID NO: 152 - protein, 1354 aa, Mus musculus
MSTGDSFETRFEKIDNLLRDPKSEVNSDCLLDGLDALVYDLDFPALRKNKNIDNFLSRYKDTINKIRDLRMKAEDYEVVKVIGRGAFGEVQLVRHKSTRKVYAMKLLSKFEMIKRSDSAFFWEERDIMAFANSPWVVQLFYAFQDDRYLYMVMEYMPGGDLVNLMSNYDVPEKWARFYTAEVVLALDAIHSMGFIHRDVKPDNMLLDKSGHLKLADFGTCMKMNKEGMVRCDTAVGTPDYISPEVLKSQGGDGYYGRECDWWSVGVFLYEMLVGDTPFYADSLVGTYSKIMNHKNSLTFPDDNDISKEAKNLICAFLTDREVRLGRNGVEEIKRHLFFKNDQWAWETLRDTVAPVVPDLSSDIDTSNFDDLEEDKGDEETFPIPKAFVGNQLPFVGFTYYSNRRYLPSANASENRSSSNVDKSLQESLQKTIYKLEEQLHNEMQLKDEMEQKCRTSNLKLDKIMKELDEEGNQRRNLESAVSQIEKEKMLLQHRINEYQRKVEQENEKRRNIENEVSTLKDQLEDLRKASQTSQLANEKLTQLQKQLEEANDLLRTESDTAVRLRKSHTEMSKSISQLESLNRELQERNRILENSKSQADKDYYQLQAVLEAERRDRGHDSEMIGDLQARITSLQEEVKHLKHNLERVEGERKEAQDMLNHSEKEKNNLEIDLNYKLKSIQQRLEQEVNEHKVTKARLTDKHQSIEEAKSVAMCEMEKKLKEEREAREKAENRVVETEKQCSMLDVDLKQSQQKLEHLTENKERMEDEVKNLALQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLRKIQELQSEKETLSTQLDLAETKAESEQLARGILEEQYFELTQESKKAASRNRQEITDKDHTVSRLEETNSVLTKDIEMLRKENEELNERMRTAEEEYKLKKEEEINNLKAAFEKNISTERTLKTQAVNKLAEIMNRKDFKIDRKKANTQDLRKKEKENRKLQLELNQEREKFNQMVVKHQKELNDMQAQLVEECTHRNELQMQLASKESDIEQLRAKLLDLSDSTSVASFPSADETDGNLPESRIEGWLSVPNRGNIKRYGWKKQYVVVSSKKILFYNDEQDKEQSSPSMVLDIDKLFHVRPVTQGDVYRAETEEIPKIFQILYANEGECRKDIEVEPVQQGEKTNFQNHKGHEFIPTLYHFPANCEACAKPLWHVFKPPPALECRRCHVKCHRDHLDKKEDLISPCKVSYDVTSARDMLLLACSQDEQKKWVTHLVKKIPKNPPSGFVRASPRTLSTRSTANQSFRKVVKNTSGKTS

SEQ ID NO: 153 - protein, 676 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 154 - protein, 303 aa, Gallus gallus
MEVRGPRRNRSYLSDLYENMLRAQGAPGQGQQQPSVVRPSSSLCLVSHPPVKVATQPHQPQSSTFSSCDPALRPIIRRRARSLPTTPERRKRVQCQAPVCQSRMNKVRFADALGLELTEVKVFQKGEDPSIPLHVLSRLSINSDLWYSNLEFTMQCLVPDFQQPADCMDFSARLQEQQVCLERVTSSDLGVSGTIQVCNIAFEKQVSVRYTFNQWKSLHEVCAHWQSSILDKNGQDQVDVFTFFLPVPSFLLQLCSIVQFAARYQVNGQEYWDNNRGKNYSLTCRTHPLKMPRECEESWIHFI

SEQ ID NO: 155 - protein, 255 aa, Gallus gallus
ENLFFVMEYLNGGDLMFHIQSCHKFDLPRATFYAAEIISGLQFLHSKGIIYRDLKLDNVLLDSEGHIKIADFGMCKENMFGDAKTSTFCGTPDYIAPEILLGQKYNTSVDWWSFGVLLYEMLIGQSPFHGQDEEELFQSIRMDNPFYPRWLDKDAKDILVKLFVREPERRLGARGNIRQHAFFREINWEALEERRIEPPFKPRVKSPSDCSNFDKEFLSEKPRLSCADRALINSMDQNMFRNFSFVNPKMENIFS

SEQ ID NO: 156 - protein, 668 aa, Bos taurus
MAPFLRISFNSYELGSLKAADEASQPFCAVKMKEALSTDRGKTLVQKKPTMYPEWKSTFDAHIYEGRVIQIVLMRAAEEPMSEVTVGVSVLAERCKKNNGKAEFWLDLQPQAKVLMSVQYFLEDVDCKQSMRGEDEAKFPTMNRRGAIKQAKIHYIRHHEFIATFFGQPTFCSVCREFVWGLNKQGYKCRQCNAAIHKKCIDKIIGRCTGTAANSRDTIFQKERFNIDMPHRFKVYNYMSPTFCDHCGSLLWGLVKQGLKCEDCGMNVHHKCQMKVANLCGINQKLLAEALNQVSQVGRHCGEPGQRVLGLGTSPSAGRDPAGQGHLLGLRSEARCNIDNFTFIKVLGKGSFGKVLLAELKGKKEFFAIKALKKDVVLIDDDVECTMVEKRVLALAGDHPFLTHLFCTFQTKDHLFFVMEFLNGGDLMYHIQDKGRFELSRATFYAAEIVCGLQFLHQKGIIYRDLKLDNVLLDHSGHIKIADFGMCKENMSGDRQASTFCGTPDYIAPEILQGLKYSFSVDWWSFGVLLYEMLIGQSPFHGDDEDELFESIRLDSPYYPRWITKESKDILEKLLERDVSKRLGVTGNIKIHPFFKTINWVLLEKRAVEPPFKPKVKSPGDFSNFDQEFLNEKPRLSYSDKNLIESMDQTAFAGFSFVNPKFERLLEN

SEQ ID NO: 157 - protein, 416 aa, Gallus gallus
MPEQVVTVAGGVTVGILLFVLIGVTAYLLWKKLCLAYSYQELPNTVKTTPVNAILQDQSSSEIQPKSTRSKSIPFIIPPTLHGRDWINLTNEEQIQEDNNSCMTPQSGPRSSFHSLAGAYIVGTVNPELYKFPEDKSETNFPEGNIGRLWFSVEYKQASERLLISLIKARKLQPPADSCSPFVKIYLLPDERCYLQSKVKRKTLNPQFDEDFVFQVSSKTLLQRTLKFLVYHVDKQKHHHLLGQVIFPLKNETLTDDSKVVVWRDLERENLESPSEYGDIQFSLSYNDYLGRLTVVVLRARGLKFQDESRDVSVYVKVSLMNHNKLVRSKKTAAVLGSPNPEYNESFSFKANQTELDTASLSLSVLQNTEQKSHVLGRVVVGPFMYSRGKELEHWNEMISKPKELVKQWHALCCST

SEQ ID NO: 158 - protein, 512 aa, Homo sapiens
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPKKPFLLGPQRLSSAHSMSDLSGSHMSSEKLKAGTIGQTHLLGHQLDSFGTVPESGSLKSPHRRTLSFDTSKMNQPDSIVDEGELCFGRQNDPFTNVTASLPQKFATLPRKKNPFEESSETWDSSMNLFSKPIEIRKENKREKREKVSLFERVTGKKDSRRSDKLNNGGSDSPCDLKSPNAFSENRQDYFDYESTNPFTAKFRASNIMPSSSFHMSPTSNEDLRKIPDSNPFDATAGYRSLTYEEVLQELVKHKELLRRKDTHIRELEDYIDNLLVRVMEETPSILRVPYEPSRKAGKFSNS

SEQ ID NO: 159 - protein, 647 aa, Mus musculus
MPSKSACLRHTEAPGQLEGRMLQGQPPNTEKKLIPTPGFLPASDSQGSETNPMPPFSIPAKTSNQNPQTKANLITPQPPIRPKLERTLSLDDKGWRRRRFRGSQEDLTVQNGASPCRGSLQDSVAQSPAYSRPLPCLSTSLQEIPKSRRATGSEGGSPSLWSDCLSGMISTSLDLLHRDAASGGPPSRLASLHASHTPPAMDLSIASSSLRTANKVDPEHTDYKLRMQTRLVRAHSNLGPSRPRSPLAGDDHSIHSARSFSLLAPIRTKDIRSRSYLEGSLLASGALLGAEELARYFPDRNMALFVATWNMQGQKELPASLDEFLLPTEADYTQDLYVIGIQEGCSDRREWETRLQETLGPQYVLLSSAAHGVLYMSLFIRRDLIWFCSEVEYSTVTTRIVSQIKTKGALGVSFTFFGTSFLFITSHFTSGDGKVAERLLDYSRTIQALALPRNVPDTNPYRSSAGDVTTRFDEVFWFGDFNFRLSGGRVAVEAFLKQKPEVDVLALLQHDQLTREMKKGSIFRGFEEAEIHFLPSYKFDIGKDTYDSTSKQRTPSYTDRVLYKSRHKGDICPMKYSSCPGIKTSDHRPVYGLFQVKVRPGRDNIPLAAGKFDRELYLIGIKRRISKEIQRQEALKSQSSSAVCTVS

SEQ ID NO: 160 - protein, 1620 aa, Mus musculus
MEAVPRMPMIWLDLKEAGDFHFQSAVKKFVLKNYGENPEAYNEELKKLELLRQNAIRVARDFEGCSVLRKYLGQLHYLQSRVPMGSGQEAAVAVTWTEIFSGKSVSHEDIKYEQACILYNLGALHSMLGAMDKRVSEEGMKVSCTHFQCAAGAFAYLREHFPQAFSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFAMDVIGGKYNSAKKDNDFIYHEAVPALDTLQPVKGAPLVKPLPVNPTDPAVTGPDIFAKLVPMAAHEASSLYSEEKAKLLREMLAKIEDKNEVLDQFMDSMQLDPETVDNLDAYNHIPPQLMEKCAALSVRPDTVKNLVQSMQVLSGVFTDVEASLKDIRDLLEEDELQEQKLQETLGQAGAGPGPSVAKAELAEVRREWAKYMEVHEKASFTNSELHRAMNLHVGNLRLLSGPLDQVRAALPTPALTPEDKAVLQNLKRILAKVQEMRDQRVSLEQQLRELIQKDDITASLVTTDHSEMKKLFEEQLKKYDQLKVYLEQNLAAQDNVLRALTEANVQYAAVRRVLSELDQKWNSTLQTLVASYEAYEDLMKKSQEGKDFYADLESKVATLLERAQSICRAQEAARQQLLDRELKKKAPPPRPTAPKPLLSRREEGEAVEAGDTPEELRSLPPDMMVGPRLPDPFLGTTAPLHFSPGPFPSSTGPATHYLSGPLPPGTYSGPTQLMQPRAAVPMAPATVLYPAPAYTSELGLVPRSSPQHGIVSSPYAGVGPPQPVVGLPSAPPPQLSGPELAMTVRPATTTVDSVQAPISSHTAPRPNPTPALPQPCFPVPQPVPQSVPQPQPLPVPYTYSIGTKQPLPAPYTYSIGTKQHLTGPLPQHQFPPGIPTGFPVPRTGPQAQAQPQPQPQPQPQPQPQPQTQPQPQSQSQSQPQPQPSGALPFPSPGPPHPHPTLAYGPAPSPRPLGPQATPVSIRGPPPASQPTPSPHLVPSPAPSPGPGPVPSRPPTAEPPPCLRRGAAAADLLSSSPESQHGGTQPPGGGQPLLQPTKVDAAEGRRPQALRLIEQDPYEHPERLQQLQQELEAFRGQLGDAGALDAIWRELQEAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSVALSSIRTTETHVERVLSLQFRDQSLKRSLVHLHFPTWPELGLPDSPGNLLRFIQEVHAHYLHQRPLHTPIVVHCSSGVGRTGAFALLYAAVQEVEAGNGIPELPQLVRRMRQQRKHMLQEKLHLKFCHEALVRHVEQVLQRHGVPPPGKPVASVNISQKNHLPQDSQDLVLGGDVPISSIQATIAKLSIRPLGGLDSPAASLPGLVEPPGLPPASLPESTPVPSSSPPPLSSPLPEAPQPEEEPSVPEAPSLGPPSSSLELLASLTPEAFSLDSSLRGKQRMSKQNFLQAHNGQGLRAAQPTDDPLSLLDPLWTLNKT

SEQ ID NO: 161 - protein, 876 aa, Xenopus laevis
MASESGAEKGPPTTPAENGQPGVPIAAAVAADEQGMISVDIAGLFYQFSKTFILIFPVYVLGYFGLSFSWLLIALVLLLWWRRNKGNKNSRLYRALAFLETEEKSVKHHIASIDLPAWVHFPDIERAEWLNKTVKHMWPYICQFIEKLFRETIEPAVRGANAHLSTFSFTKIDMGSQPLRINGVKVYTENVDKRQIILDLQISFVGETEIDLEVKRYFCRAGVKSIQLHGTMRVILEPLIGDVPIVGALSIFFLRKPLLEINWTGLTNMLDMPGLNGLSDTIILDIISNYLVLPNRITVPLVSDVQIAQLRFPIPKGVLRIHFLEAQDLMWKDTYMKGLVKGKSDPYGVVRLGNQVFQSKVIKENLNPKWNEVYEALVHEHPGQELEIELFDEDTDKDDFLGSLLIDLVEVEKERVVDEWFTLDEATSGKLHLKLEWLTPKSTTENLDQVLKSIKADKDQANDGLSAALLILYLDSARSLPNNPLEINHDGMKKAAVEKAKKAGKKIGSSPNPYVLFSVGHTVQESKVKYKTAEPVWEQTFTFFVHNPKRQDLEVEVKDENHQNSMGNIKIPLSQILASEDLTLNQRFHLNNSGPNSSLKMKIALRILHVEKPVRSPDEQHTSQVKRPSIFKGKQPPTPQMPAPSPAVAHKPPPTPKLETNKKLENGNKSSTPSASPKRPTELHKSSSSLSGSSFTYSPPHLPTKEPTPSIASDISLPVATQELRERLRQLQNGTTLGQSPLGQIQLTIRHSSQRNKLMVVVHSCRNLIAFSEEGSDPYVRIYLLPDKRRSGRRKTHVHKRTLNPIYDQTFEFSVSLADLQRRTLDVAVKNGGGFLFREKGLLGKLLLEINTEDAAKGWTQWFDLTEDGTRAAASS

SEQ ID NO: 162 - protein, 305 aa, Xenopus tropicalis
MICVLPGLYLGSASDAADQQRLQEAGITHVLTVDSEAPTGLDGFITKFVHVLDDASQDLLSCLPACTDFLKEALGKCGRSVLVHCHSGVSRSAAVIAAYLMHTSNLSLEDACSRLQVLKSDIRMNEEFLGQLSLYETMGCDVDMTCASYKQYRLQKVTEKYPELLKLPQEVFASDPCSMAQTAEVLYRCRKCRRSLFRETSILNHALGTGAAAFAHKRPPSLQKVDSTKCTSYFVEPVQWMEEALLGVMDGQLLCPKCSSKLGSFNWYGVQCSCGRWVTPAFQIHKNRVDEAKTLHIRGIQQSDT

SEQ ID NO: 163 - protein, 1693 aa, Gallus gallus
MAQLSSSNGFKQRSSPSLATARSKDVDKEEALQMEAEALAKMQKERGIAGNKQTSHSLSSTGHVAQTHSKQDHDLMVFPESDAKRMEDKLSTIDIEKLTHAELEKLLLDDSFESSKVPALPVTPILSPSLSSQFYIGPTGQRGQWTPGIPAPVTCTLPPIYPSASYIKQTSVFQNGFHPSMSSYRSREPIYFGLPRQSQYISYPLAATTPFHPQGSLPIYPPVLTPELAKVFDKIASTSEFLRNGKSSTDLEMTAIKSAVSSLPASEKCRDISKFDWLDLDPLSKPKVDSVETLYKAEDRGEMASGMTAEDPWDAVLLKEKLLVTCHLERKINGKSSGATVTRSQSLNMRTTQLGKLQGQTSQKDNGTTGTLTENVLLQEMEGQNQELSAFSQAVTKLRTKFPYTDQQSNPGFVLSPIMLQRNITGESASIKVSIEIKGFQQPVTFTCDVSSPVELIIMQALCWVHDDLNEVDIGSYFLKVCGQEEVLQNKHCVGSHEYIQNCRKWDTEIKLQLVTHTEICRGLARTEEDDSTPIDLTKHLYKVEKPFREPNIRSSIEELLDIYHKQIEIALKNENQHKAVDHLIKTVRKICSTLDGVETPAITESVKKLRRAVNLPRIKDTEVSLKCGDDASKSSSGSLQPESPLKVSIDLLTRAVEALVRLHMNSCSMSSATVSPEDKTTKEAWTATEHLQFTIFAAHGIFPDWVSNFEKYYLICSLTHNGKDLFKPVQSKKAGAYKNFFYLIKWDELIIFPIQISQLPLESVLCLTLFGILNQSSGSSPDSNKQRKGPEMLGQVSLPLFDFRRLLSCGTKLLQLWTSLHPSHASGTASKKENMGRIVLQVDFPSHAFDIEYKIPQAAKTTVHHSIEALEKPLRERLLAILSRDNTIGLSKEDKEFLWERRHYCHGHTNSLPKILASAPHWDWASLPEIYSLLQQWPPLSPLAALELLDSKFADQEVRNTAVNWIETLSDDELTDFLPQFVQALKYETYLDSALVKFLLARALGNIRIAHYLYWLLKDTLYDPKFGVRYEQILGAFLSVCGKGLREELEKQTRLVLLFGMVAEKVKQTSVSGRQTALQSGMERVQSFFLKNKCRLPLNPSLVAKELNIKACSFFSSNAVPLKIALINADPLGEEINVMFKVGEDLRQDMLALQMIKIMDKIWLQEGLDLRMVIFKCLSTGKDRGMVELVPASETLRKIQVEYGVTGSFKDKPLAEWLRKYNPTEEEYEKASENFIYSCAGCCVATYVLGICDRHNDNIMLRNTGHMFHIDFGKFLGHAQMFGSFKRDRAPFVLTSDMAYVINGGEKPTIRFQLFVDLCCQAYNLIRKHANLFLNLLSLMLSSGLPELSGVQDLKYVQDALQPQTTDAEATIFFTRLIESSLGSVATKFNFFIHNLAQLRFSGLPSNDEPILSFSAKTYSLKQDGRIKQVSVFTYQKRYNPDKHYIYVVRVLREGQAEPTFVFRTFDEFQELHNKLGILFPLWKLPGFPNKMVLGRTHIKDVAAKRKVELNSYIQSLMNSSPEVAECDLVYTFFHPLLRDDKVEGIDGIARSTDASPSSPTSGKVGGEVKLSISYRNSTLFIMVMHIKDLVTEDGADPNPYVKTYLLPDTHKTSKRKTKISRKTRNPTFNEMLVYSGYSVETLKQRELQLSVLSAESLRENFFLGGITLSLKDFNLSKETVNWYRLTAVPYL

SEQ ID NO: 164 - protein, 1195 aa, Canis familiaris
MASQVLVYPPYVYQTQSSAFCSVKKLKIEPSSCVFQERNYPRTYVNGKNVGNSHPPTKGSVFQTKIPFNRPRGHNFSLQTSAVVLKNTAGATKVIAAQAQQAQVEAPQIGAWRHRLHFLEGPQRCGLKRKSEELDNHSSAMQIVDELSILPAMLQTNMGNPVTVVTTTTGTKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCRETEISHSGWRLKTLEEHEAETGMKSKEARKYIFNSLDDIVHVNTVMDLEGSDLLAEKADRREFVSLLKKMLLIDADLRITPAETLNHPFVNMKHLLDFPHSNHVKSCFHIMDICKSHPNSCDTNNHNKTSLLRPVASGNTANLTANFTKIGTLRNQALTTSAHSVVHHGIPLQAGTAHFGCGDAFQQTLIICPPAIQGIPATHGKPTSYSIRVDNTVPLVTQAPAVQPLQIRPGVLSQQTWSGRTQQMLVPAWQQVTPMAPATTALTSEGVAGSQRLGDWGKMISHSNHYSSVMPQPLLTNQITLSAPQPISVGIAHVVWPQPATAKKNKLCQNRSNSLQNTNVPHSTFISPKIVNGKDVEEVRCVETQDNHNSEGGARDCCETSVQQDSDSSVSDKQRQTIIIADSPSPAVSVITISSDTDEEETSQRHSLRECKDSLDCEACQSTLNIDRMCSLSSPDSTLSTSSSGQSSPSPCKRPNSMSDEEQESGCDTVDGSPTSDSSGHDSPFAESSFVEDAHQNTELVTSANTETKPAVCTVVVPPMGLENGLNADEHMSNTDSICQPLIKGRSAPGRLNQPSTVGNRQQKLTSAFQQQHLNFSQVQHFGSGHQEWNGNFGHRRQQAYIPTSVTSNPFTLSHGSPNHTAVHAHLAGSAHLGGQPTLLPYPSSATLSSAAPVAHLLASPCTSRPMLQHPTYNISHPSGIVHQVPVGINPRLLPSPTIHQTQYKPIFPPHSYIAASPAYTGFPLSPTKLSQYPYM

SEQ ID NO: 165 - protein, 1059 aa, Xenopus laevis
MAPAEWALCFLCLFQVTSGLYFLRKDYYENVYVDQPAGTLLLQVHVMKDSPSEKPHFRLCPTINFSRNSFYHWFRIDEHTGNLYLNRSLDRSDYEVFSQGSQSAIQKITLKVSTKPHPFLDKDCNNAPLTWVHLNFINLTSSICFSLKPKDLCFNDKDLSFHIKENKPPGKFYKFHPRPIVQSCPNVSVSYMLISDHSYPFRFNPNTSEVSLTHSVDREERENYDLVAKCLLRDASSEVEVEQSFQIKVDDEDDTAPFLPNGTDTAHVVVDFKRKNGTVLGMLTVWDADSTPVYPADVSRKKYTKTIVSKDRFILENFRVEHSFKEVKFQPKGNLIRGTLHEYRLVLNKSIPIIRNGSLLVSVLVNDTEFHGPNGDVMLYFNVTILSMEIRFPNISYQYTVNRNADRYAQIGKICIENCKLVEGVNINYRLQTENNTHAFAIIQGRESTFATLIVNDSDALATHESKEIVCTVFATNKHLKEPVRTQIIIVLEGTPMKDEDNCPHSCSESRQKSECEECGGLGSLTGRCQWRQGHGEGITTNYSTCTPSLLTCPDGICDAVEMNDSAICPQDCTEITIIGGHEKGRLKGIKAGYGTCFCLLPDKCFCEKNIVEGQLCDDTCKTVIACGVFLSFIISVLLSSYFIHRYHKNSPKPPIASAEMTFRRPAQSYPVSYSSNNARRPSLDSMENQMSVDTFKIPEDPKWEFPRKNLVLGKTLGEGEFGKVVKATAFRLKGKAGYTTVAVKMLKESASQSELRDLLSEFNLLKQVNHPHVIKLYGACTQDGPLHLIVEYSKYGSLRSFLRESRKVGPSTLGGDSNRNSSYLDNPDERALTMGDLISFAWQISRGMQYLAEMKLVHRDLAARNVLVAEGRKMKISDFGLSRDVYEEDSYVKRSKGRIPVKWMAIESLFDHIYTTQSDVWSFGVLLWEIVTLGGNPYPGIAPERLFNLLKTGYRMEKPENCSDEMYNLMLKCWKQEPEKRQTFGEISKELEKMMVKSRDYLDLAASTPADSLLYDDGLSEEETPLVDCNNAPLPRTLPSTWIENKLYGRISHAFTRF

SEQ ID NO: 166 - protein, 1243 aa, Bos taurus
MRSRSNSGVRLDGYARLVQQTILCYQNPITGLMSASHEQKDAWVRDNIYSILAVWGLGMAYRKNADRDEDKAKAYELEQNVVKLMRGLLQCMMRQVDKVERFKHTQSTEDSLHAKYNTATCSTVVGDDEWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFNGDAVQVQEYREALEGILIRGNNGVHLLPELYAIPPDKVDEEYKNPHTVDRVPLGKVPHLWGQSLYILSSLLAEGFLAAGEIDPLNRRFSTSVKPDVVVQVTVLAENNHIKELLRKHGVNVQSIADIHPIRVQPGRILSHIYAKLGRNKNMRLSGRPYRHIGVLGTSKLYVIRNQIFTFTPQFTDQHHFYLALDNEMIVEMLRIELAYLCTCWRMTGRPTLTFPITHTMLTNDGSDIHSAVLATIRKLEDGYFGGARVKLGSLSEFLTTSFYTYLTFLDPDCDEKLFDDASEGTFSPDSDSDLGGYLEDTYNQESQDELDQYINHLLQSTSSKCYLPPLCKKTEDNQVFSAIHSTRDILSVMAKAKGLEIPFVPMALPTKVLSAHRKSLNLVDSPQPLLKKAPEDDFQFPRDDHGDVDCEKLVEQLKDCSNLQDQADILYILYVIKGPSWDTNLSGQHGVTVHNLLSELYAKAGLNQEWGLIRYISGLLRKKVEVLAEACTDLLSHQKQLTVGLPPEPREKTISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSMRPIHSSTPSPAVSIHEVGHTGVTKTERSGINRLRSEMKQVRRALSARKEVCGDHHAPQEERSPHALSSLGCRAARRSSTPSSPTGTSSSDSGRQHMGWGERQGQWLRRRRLDGAINRVPVGFYQKVWKILQKCHGLSIDGYVLPSSTTQEMTPQEIKFAVHVESVLNRVPQPEYRQLLVEAIMVLTLLSDTEMNSIGGIIHVDQIVHMANQLFLQDQVSSGATDTLEKDQATGICHFFYDSAPSGAYGTMTYLTKAVASHLQELLPNSGCQMQ

SEQ ID NO: 167 - protein, 547 aa, Homo sapiens
MAEPSGSPVHVQLPQQAAPVTAAAAAAPAAATAAPAPAAPAAPAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 168 - protein, 653 aa, Mus musculus
MTSTGKDGGGAQHAQYVGPYRLEKTLGKGQTGLVKLGIHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDERNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSHEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRTRLNSIKNSFLGSPRFHRRKLQVPTPEEMSNLTPESSPELAKKSWFGNFINLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDQPSAQHLSGIIPKS

SEQ ID NO: 169 - protein, 1867 aa, Mus musculus
MARLADYFVLVAFGPHPRGSGEGQGQILQRFPEKDWEDNPFPQGIELFCQPSGWQLCPERNPPTFFVAVLTDINSERHYCACLTFWEPVESTQEVVCTDNATEKEEEADGGGQARLSSTAPAQPGQLFAPKTLVLVSRLDHAEVFRNSLGLIYAIHVEGLNVSLENVIGNLLTCTVPLAGGSQRTISLGAGDRQVIQTPLVDSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTVPECVHIPPLPEPLQSQTHNVLSMVLDPELELADLAFPPPTTSASSLKMQDKELRAVFLRLFAQLLQGYRWCLHIVRIHPEPVIRFHKAAFLGQRGLVEDDFLMKVLEGMAFAGFVSERGVPYRATDLFDELVAHEVARMRADESHPHRVLRHVQELAEQLYKNENPYPAVAMHKVQRPGEASHLRRTHRPFPRLDEGTIQWIVDQAAAKMQGAPPAVKAERRSTVPSGPPMTAILERCSGPHINSARRLEVVRNCISYVFEGKMLEAKKLLPAVLRALKGRAARRCLAHELHLHVQQNRAVLDHQQFDFVVRMMNCCLQDCTSLDEHGIASALLPLVTAFCRKLSPGVTQFAYSCVQEHVVWSTPQFWEAMFYGDVQTHIRALYLEPSDGVSPTQETGEAQSQDDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVHRESKRLPPIQKPKLLRPRLLPGEECVLDGLRVYLLPDGREEGVGGSGGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSFRTLSRNLMKNAKKTIGRQYVTRKKYNPPGWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSIQDNALQRVSRCYRQNRFPVVCWRSGRSKAVLLRSGGLHGKGVVGLFKAQNTPSPGQAQADSSSLEQEKYLQAVVSSMPRYADSSGRNTLSSFSSAHMGGHGKWSSVRASGRSSGLGSDVGSRLAGRDLLSTPHTNGAPPDSGFLRPQRAALYIIGDKAQLKGVRPDPLQQWELVPIEVFEARQVKASFKKLLKACVPGCPATEPSPASFLRSLEDSEWLIQIHKLLQISVLVVELLDSGSSVLVSLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHTSRRFRTFLLDSDYERIELGLLYEEKGERRGQLACKSVWEYVDRLSKRTPMFYNYTYAPEDTEVLRPYSNVSNLKVWDFYTEETLAEGPPYDWELAQGPPEPPEEERPDGGAPQSRRRVVWPCYDSRPRVQPDAISRLLEELQRLETELGRPSERWKDTWDRVKAAQRLESRQDGRGTPSSLLVSAVPHHRRSLGVYLQEGPVGSTLSLSLDSDQSSGSTTSSSRQAARRSTSTLYSQFQTAESENRSYEGILYKKGAFMKPWKARWFVLDKTKHQLRYYDHRMDTECKGVIDLAEVEAVAPGTPTIGAPKTVDEKAFFDVKTTRRVYNFCAQDVPSAQQWVDRIQSCLSDA

SEQ ID NO: 170 - protein, 1015 aa, Canis familiaris
MHRFLELNSRYCFSFSGIVQMEEDKHYNKVEDVVGSHVEDAVTFWAQSISRNKDIMKIGCSLSEVCPHANSVFGNLDPKKIYGGLFSEDKCWYRCKVLKIISDEKCLVRYIDYGNTEILNRSDIVEIPLDLQFSSVAKKYRLWGLQIPSGQEVTQFDQGRTFLGSLIFEKEIKMRTKATYQDGTVIAQAEYGSVDIGEEVAKKGFAEKCKLTSSTNACEEKKSDPGQLVLKNLKSPIPSWGHRSNQSAFTRPKGRLSGRMTLDLKNENDAGNHVTFPKENLAVGDFNLGSNVSLAKIKQDQKLIEENERLKTEKEVLLESYKALESKVEQTAQELQQEKATTMDLTKHLESTLKTCVGTRMENLAVKVEILKEIRRVNINVRFGNDLSDAMQVLEEESFTIPASLTELERIWAEYSLAQENIQTCQNVDEGSILIAKRNEVQQKLNMAMEVFILEVDELPLNKRLKTLQDLSTSLEAVYGQAKEGTKSEEILKKFYDWKCDKREEFISVRSETEVSLQRLVAWFQNTVKAFDLSVEETQTSKDTINNVDEILEKTESSVCKELEISLIEHGDADKEIILNTYSQILQKIHSEERLIATVQSKYKDSIEFKKQITECLNKSSNVDHLLSIKKTLKNLKARLRWKLVEKNNLEESDDHDGSEIEKIKQEITQLRNSVFHEIYREQEEYEKLNCLVQKWFPELPLLYPEIGLLKYMNSGGLLTMSLERDLLDAEPMKELSSKRPLVCSEVNGQIILLKGYSVDVDTEARVIQRAAAYHRAWREAKEGSGLLPLIFLFLCKSDPMVYLMVPYYPRANLSAVQASVPLTSEEALKVMKGVAQGLHTLHKADIIHGSLHQNNVFALNREQGIVGDFDFTKSVSQRTSVNMMVGDLSLISPELKMGKPASPSSDLYAYGCLLLWLSVQNQKFETNEDGIPKVDQFRLGDNVKSLLYSLIYCRSSMTAEQVLNAECFLVPKGKSTPNPEKDTEYTQYKEKEELKMENLDQYKEKTRNGEASFD

SEQ ID NO: 171 - protein, 639 aa, Homo sapiens
MALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVRAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 172 - protein, 687 aa, Pan troglodytes [sequence omitted]

SEQ ID NO: 173 - protein, 1190 aa, Mus musculus
MGEEGPPSLEYIQAKDLFPPKELVKEEENLQVPFTVLQGEGVEFLGRATDALIAISNYRLHIKFKDSVINVPLRMIDSVESRDMFQLHIACKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRASGGSLSTGTNDASEACDTDFDSSLTACSGVESTAAPQKLLILDARSYTAAVANRAKGGGCECEEYYPNCEVLFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENAEDQNEQCPVFLQWLDSVHQLLKQFPCLFEFNEAFLVKLVQHTYSCLYGTFLANNPCEREKRNIYKRTCSVWALLRAGNKNFHNFLYTPGSDVVLHPVCHVRALHLWTAVYLPASSPCTLGEENMDLYLSPVAQSQEFSGRSLDRLPKTRSMDDLLSACDTSSPLTRTSSDPNLNNHSQEVRGSLEPWHSSPEGAETVIDSGVGSPQLTVGEMGLPPPLPSSQKEYLSNKPFKGHKSCSLSYKLLNTSVSWEMKSNTSDIKVLEETEALAPDPSAQEEQGRTSDGLGKPPEQFLEKEAVSSLCSVSSKCGGACDFPEPPQDPLTGTPQQPHLDSMQISPSRCTPDHSQGSLCNPPSVASQTPEPNTDLLSQDPPGSTASISHQEQPSSVPDLIYKKEDAGKRGSKNGQLLENPRFGKMPLELARKPISQSQISEFSFLGSNWDSFQGMMTSFPSGETTPRRLLAYGCCSKRPSNKHIRAAGPCLGGQWAQREGMKSPVCSSHSNGHCTGPGGKNNRMWFSSHPKQVSSTKPSLLSCPSPVPPLYLDDDGLPFPTDVIQHRLRQIEAGYRQEVEQLRRQVRELQMRLDIRHCCAPPAEPPMDYEDDFTCLKESDGSDTEDFGSDHSEDCLSEASWEPVDKKETEVTRWVPDHMASHCFNCDCEFWLAKRRHHCRNCGNVFCAGCCHLKLPIPDQQLYDPVLVCNSCYEHIQVSRARELMSQHLKKPIATASS

SEQ ID NO: 174 - protein, 543 aa, Xenopus tropicalis
MAAADLRDELSCSICTSIYTDPVSLPCGHNFCRGCIGGVLGTQEGSGAYSCPECRAEYQECPALPRNRALGNIAERFRPTETEPGETGIFCTYCLLSPVPAAKSCLLCEASLCDTHLRGHCQSAEHVLTEPTASFMGRKCSVHNELLKYFCCEDSACICVSCCLAGEHRGHRVELLSEASEKKKEKLRKVLEKLSPEREETERGAQRLQERRREVAEVAAGETERVTALFRGIREELEALEKRLLSDISRQKEELSLTLTELIQQLEIKKDELSRKIHHIEELCNMADPLTVLQEQWESHGAAFCGAEGADTEGREREDTEGGDRKRRKINHIKVPAVGDLDVGRISETLLTGLAGIVTGVEGRIYGQGDTELVLDRNTAGNHVSVSGDGKSASYSHTDQRRPQTPERFQYYPQTLSTRSFPSGRHYWEVEVSESGGWGVGAAYPSIERGGGQSLIGNNNKSWCLYKWNNNYTVTHDRKVTRLPHVPSCRRIRISLDYEAGRLSFYELSEPIRHLHTFTASFTEPLHAAFCVVGGGACVRIIS

SEQ ID NO: 175 - protein, 1055 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 176 - protein, 335 aa, Homo sapiens
MWATLPLLCAGAWLLGVPVCGAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 177 - protein, 564 aa, Homo sapiens
MVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAKVLPPSPWAPAPADGPQPPKDSATPLSPQPPSEEPATSPWPAEQSPKSRTSEEMGAGAPMREPGSPAESEGRDQAQPSPVTQPGASA

SEQ ID NO: 178 - protein, 1843 aa, Mus musculus
MEAPERAGGGEPPEPGGRPVLGPRAFVPQKEIVYNKLLPYAERLDAESDLQLAQIKSNLGRAVQLQELWPGGLFWTRKLSTYIRLYGRKFSKEDHVLFIKLLYELVSIPKLEISMMQGFARLLINLLKKKELLSRDDLELPWRPLYDLVERILYSKTEHLRLNSFPNSIENVLKTLVKSCRPYFPADSTAEMLEEWRPLMCPFDVTMQKAISYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERFKKPSWLTPVPESHKLTDEDVTDFVQCIIQPVLLAMFSKTGSLEAAQALQNLALMRPELVIPPVLERTYPALETLTEPHQLTATLNCVIGVARSLVSGSKWFPEGPTHMLPLLMRALPGVDPNDFSKCMITFQFIGTFSTLVPLVDCSSVLQERNDLTEIEKELCSATAEFEDFVLQFMDRCFGLIESSTLEQTREETETEKMTHLESLVELGLSSTFSTILTQCSKDIFMVALQKVFNFSVSHIFETRVAGRMVADMCRAAVKCCPEESLKLFVPHCYGVITQLTMNDDVLNEEELDKELLWNLQLLSEITRVDGKKLLLYREQLVKILQRTLHLTCKQGYTLSCNLLHHLLRSTTLIYPTEYCSVPGGFNKPPSEYFPVKDWGKPGDLWNLGIQWHVPSSEEVSFAFYLLDSFLQPELIKLQCCGDGELEMSRDDILQSLTIVHSCLIGSGNLLPPLKGEAVTNLVPSMVSLEETKLYTGLEHDLSRENYREVIASVIRKLLSHILDNSEDDTKSLFLIIKIIGDLLHFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRKDVTQQQFKGALYCLLGNHSGVCLANLHDWDCIVQTWPALVSSGLSQAMSLEKPSIVRLFDDLAEKIHRQYETIGLDFTIPKSCAAIAELLQQSKNPSISQTLLSPEKIKEGQKRQQDKNADALRNYECLVNTLLDGVEQRNLPWKFEHIGIGLLSLLLRDDRVLPLRAIRFFVENLNHDAIVVRKMAISAVAGILKQLKRTHKKLTINPYEISGCPKPTKILAGDRPDNHWLHYDSKNIPRTKKEWESSCFVEKTHWGYYNWPKNMVVYAGVEEQPKLGRSREDMIEAEQIIYDRFSDPKFVEQLITFLSLEDRKGRDKFSPRRFCLFKGIFRNFDDAFLPVLKPHLERLVADSHESTQRCVAEIIAGLIRGSKHWTFEKVEKLWELLCPLLRTALSNMTVETYNDWGTCIATSCESRDPRKLHWLFELLLESPLSGEGGSFVDACRLYVLQGGLAQQEWRVPELLHRLLKYLEPKLTQVYKNVRERIGSVLTYIFMIDVSLPNTAPTTSPCIPEFTARVLEKLKPLTDVDEEIQNHVMEENGIGEEDERTQGIKLLKTILKWLMASAGRSFSTAVKEQLQLLPLFFKIAPVENDNSYDELKRDAKLCLSLMSQGLLYPQQVPLILQVLSQTARSSSWHARYTVLTYLQTMVFYNLFIFLNNEDAVKDIRWLIICLLEDEQLEVREMAATTLSGLLQCNFLTMDSAMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 179 - protein, 751 aa, Xenopus tropicalis
MKTWLKWLLGILMGAVVVTVVAVPVALLATKGKEDTRKTFTLEDYFGDEYRAKSFGLKWVSENEFLFRTKDNVLIYNVDNEKTTEMISNTTIYNSNSSFYTLSDNRNYALLQYNYEKLWRHSYTASYHIYDTVKGEIVTANVLPNQIQYITWSPVGNKLAYVWENNIYIKETPGGSSIQITTNGEHNKILNGIPDWVYEEEMFSTNYALWWSPDAASLAYVEFNDTDVPAIEYSFYGEDSDQYPKTVVIPYPKAGAKNPTVRLFVVNTASLPAFNSVEIPPPAELRTIDYYINGMNWVTNGKMAVQWLRRIQNVSLLTVCDFAAPAWNCQPPVYEQSTTGWVGYFQPSSPYFTQDGQKYYKVISNKEGYKHIHLFEGAKEPVAITSGKWEVTSITTVASNLLYYISNEGFPGRRQLYKIRLDGGSNSAQCVTCNIRQERCQQYSAYFSKDSKYYALNCNGPGVPIYTLYNSSNDKEMHIMEDNEELKLLLDEVQMPTKENKSIIIDGFELWYQLTLPPNFDKSKKYPLLIDVYGGPCSQKVDQYFRLNWATYLASTEKIIVASFDGRGSGYQGDKIMHQLYHKLGTLEVQDQIAAARYFITLGFVDPKRIAIWGWSYGGYVTSMVLGSGSGLFKCGIAVAPVSSWEYYDSIYTERYMGLPTPEDNLENYLSSTVMARAQKFKDVEYLLIHGTADDNVHFQQAAHISKALVDAQVDFDTMWYTDKDHGIGGTANRHIYTHMSHYLKQCFNIQ

SEQ ID NO: 180 - protein, 316 aa, Mus musculus
MICAQLEAAKNLYQNRFLGLAAMASPSRNSQSRRRCKEPLRYSYNPDQFHNIDIRNGAHDAITIPRSTSDTDLVTSDSRSTLMVSSSYYSIGHSQDLVIHWDIKEEVDAGDWIGMYLIGEVSSENFLDYKNRGVNGSHRGQIIWKIDASSYFVESETKICFKYYHGVSGALRATTPSVTVKNSAAPIFKGIGSEETAQSQGSRRLISFSLSDFQAMGLKKGMFFNPDPYLKISIQPGKHSIFPALPHHGQERRSTIIGNTVNPIWQAEHFSFVSLPTDVLEIEVKDKFAKSRPIIKRFLGKLSMPVQRLLERHAIG

SEQ ID NO: 181 - protein, 979 aa, Homo sapiens
MSPLKIHGPIRIRSMQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSKLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAISRPLKASQMVNSCITSPSTPSKKFTFKSKSSLALCLDSDSEDELKRSVALSQRLCEMLGNEQQQEDLEKDSKLCPIEPDKSELENSGFDRMSEEELLAAVLEISKRDASPSLSHEDDDEPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAETGNLPHSYRLISVVSHIGSTSSSDHYISDVYDIKKQAWFTYNDLEVSKIQEAAVQSDRDRSGYIFFYMHKEIFDELLETEKNSQSLSTEVGKTTRQAS

SEQ ID NO: 182 - protein, 332 aa, Xenopus tropicalis
MGPSSICLVALLSLLIPAHSAPDPTLDTHWQLWVKTHQKSYKDTEEERTRRTIWEETLKFITVHNLEYSLGLHTYEVGMNHLGDMTGEEVAATMTGYTGSGGSLANMTEVPKEIQEAQPPASIDWRTQACVTPVRDQGPCGCCYAFSAVGAMECQAKRKRGMLFTLSPQELVDCSDTEGNNGCKGGRLMSAFTYMMKHGVMEENAYRYTGQEADCRRQVHTGLKVTAIHNVAAGDENVLMHAVGTVGPVSVNIDSNRKGFRLYKSGVYYDPYCTTNLDHSVLVVGYGTDNGNDYWLVKNSWGAGYGDKGYIKMARNRNNHCGIAQEAVFPTI

SEQ ID NO: 183 - protein, 374 aa, Homo sapiens [sequence omitted]

SEQ ID NO: 184 - protein, 394 aa, Canis familiaris
MGLGACVSSAASGAQAQARWLGAVLGALCLLPVLLLLARPGAPAARLGASAAQGDLAAPYPVGVFATPGPSPLPLQAPRRRRYTLTPARLRWDHFNLTYRILSFPRNLLSPSETRRGLATAFRMWSDVSPFSFREVAPEQPSDLRIGFYPVNHTDCLVSALHHCFDGPTGELAHAFFPPHGGIHFDDSEYWVLGPTRYSWKKGVWLTDLVHVAAHEIGHALGLMHSQHGRALMHLNATLRGWKTLSQDELWGLHRLYGCLDRLFVCTSWARRGFCDTRRRLMKRLCPSSCDFCYEFPFPTVAATAPPPRTKTRLVPEGRNVTFRCGQKILHKKGKVYWYKDQEPLEFSYPGYLALGEAHLSIIANAINEGTYTCVVRRRQRVLSTYSWRVRVRG

SEQ ID NO: 185 - protein, 3542 aa, Canis familiaris
MTPRDDDEDNLSDIEGGDGLQLRKEHTLKIFAYINSWTQRQCLCCFKEYKHLEIFNQVVCALINLVIAQVQVLRDQLCKHCATINIDSTWQDETNQVEEPLNIERECNEGSTERQKSIEKKPNSTRICNLTEEESSKSCDPFSLWSTDEKEKLLLCVAKIFQIQFPLYTAYKHNTHPTIEDISTQESNILGAFCDMNDVEVPLHLLRYVCLFCGKNGLSLMKDCFEFGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNLPIGNKKEEEELRRAAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEDDEDDDHGHNPTKSSCGTDLRNRKLESQAGICLGDSQGPSERSGTSNGTGKDLVFNTESMPSVDNRIRMLDACSHSEDPEHDISGEMNAAHIAQASQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPAVHKHQFNSNAVTDINLDNVCKKGNTLLWDIVQDDDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQAVREGRQKHALYSHSAEVQVRLQFLTCVFSTLGSPDHFRLSLEQVDILWHCLVEDAECYDDALHWFLNQVRSKDQHAMGMETYKHLFLEKMPQLKPETISMTGLNLFQHLCNLARLATSAYDGGSNSELCGMDQFWGIALRAQSGDVSRAAIQYINSYYINGKTGLEKEQEFISKCMESLMIASSSLEQESHSSLTVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSSRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVEDSESLRCEELHLHAENLSRRVWELLMLLPTCPNMLMAFQSISDEQSNDGLNWKELLKIKSAHKLLYALEIIEALGKPNRRIRRESTGSYSDLYPDSDDSSEDQVENSKNSWSCKFVAAGGLQQLLEIFNSGILEPKEQESWTVWQLDCLACLLKLICQFAVDPSDLDLAYHDVFAWSGIAESHRKRTWPGKSRKAAGDHAKGLHIPRLTEVFLVLVQGTSLIQRLMSVAYTYDNLAPRVLKAQSDHRSRHEVSHYSMWLLVSWAHCCSLVKSSLADSDHLQDWLKKLTLLIPETAVRHESCNGLYKLSLSGLDGGDSINRSFLLLAASTLLKFLPDAQALKPIRIDDYEEEPMLKPGCKEYFWLLCKLVDNIHIKDASQTTLLDLDALARHLADCIRSREILDHQDGNIEDDGLTGLLRLATSVIKHKPPFKFSREGQEFLRDIFNLLFLLPSLKDRQQPKCKSHSSRAAAYDLLVEMVKGSVENYRLIHNWVMAQHMQSHAPYKWDYWPHEDVRAECRFVGLTNLGATCYLASTIQQLYMIPEARQAVFTAKYSEDMKHKTTLLELQKMFTYLMESECKAYNPRPFCKTYTMDKQPLNTGEQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSDRKEGFKEVSDHSKDTESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEEENGKEFKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDASVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSERHLTLSQTDMAALTGGKGFPFLFQHIRDGINIRQTCNLIFSLCRYNNRLAEHIVSMLFTSIAKLTPEAANPFFKLLTMLMEFAGGPPGMPPFASYILQRIWEVIEYNPSQCLDWLAVQTPRNKLAHSWVLQNMENWVERFLLAHNYPRVRTSAAYLLVSLIPSNSFRQMFRSTRSLHIPTRDLPLSPDTTVVLHQVYNVLLGLLSRAKLYVDAAVHGTTKLVPYFSFMTYCLISKTEKLMFSTYFMDLWNLFQPKLSEPAIATNHNKQALLSFWYNVCADCPENIRLIVQNPVVTKNIAFNYILADHDDQDVVLFNRGMLPAYYGILRLCCEQSPAFTRQLASHQNIQWAFKNLTPHASQYPGAVEELFNLMQLFIAQRPDMREEELEDIKQFKKTTISCYLRCLDGRSCWTTLISAFRILLESDEDRLLVVFNRGLILMTESFNTLHMMYHEATACHVTGDLVELLSIFLSVLKSTRPYLQRKDVKQALIQWQERIEFAHKLLTLLNSYSPPELRNACIDVLKELVLLSPHDFLHTLVPFLQHNHCTYHHSNIPMSLGPYFPCRENIKLIGGKSNIRPPRPELNMCLLPTMVETSKGKDDVYDRMLLDYFFSYHQFIHLLCRVAINCEKFTETLVKLSVLVAYEGLPLHLALFPKLWTELCQTQSAMSKNCIKLLCEDPVFAEYIKCILMDERTFLNNNIVYTFMTHFLLKVQGQVFSEANCANLISTLITNLINQYQNLQSDFTNRVEISKASASLNGDLRALALLLSVHTPKQLNPALIPTLQELLSKCRTCLQQRNSLQEQEAKERKTKDDEGATPVKRRRVSSDEEHTVDSCISDMKTETREVLTPTSTSDNETRDSSIIDPGTEQDLPSPENSSVKEYRMEVPSSFSEDMSNIRSQHAEEQSSDGRFEDCKEFKDLHCSKESNLAEEESEFPSTSISAVLSDLADLRSCDGQALPSQDPEAALSLSCGHSRGLFSHMQQHDILDTLCRTIESTIHVVTRISGKGNQAAS

SEQ ID NO: 186 - protein, 911 aa, Xenopus tropicalis
MEGATGLVWIWVGSMTLLALTVPTSSGNRNQSEHLKDIVEHSEIIEPHWLGDFFIGMEAGGKYPEHAELLVKAEGQDLILSLHRNEQFIHPNYRETHYSLNYTRVVRTPNMTEHCYYHGIVQEQDNSSVVISICSGIRGMITLSNNLSYIVEPLPGEDGRHVIYKAEHLGLSRICHGHSIHFEEKLPTLTSNLSGHHSRVRRENVEGERCVELYLVADYAEFQKHDSDLEETQRKMLEVMNYIDKFYRALNIRIALVGLEVWTAGDKCNVSENPYSTLRAFLSWRRKLLQHTPHDNAQLITGRSFYGTTIGLAPLQAMCSVYQSGGVNMDHSDNAIGVAATMAHELGHNFGMSHDAAGCCTAKPEEGGCIMAASTGHPFPKVFNACNKQELDRFFRSGGGMCLSNLPDTKTLFGGPRCGNGFLEEGEQCDCGDPEQCNNPCCNATTCTLMAGADCAHGACCLRCKLRPPGFPCRKPSRPCDLPEFCTGQSAVCPPNSFQLDGTLCQGEQAFCYNGRCLTHQQQCQQLWGARSRVAPDLCFELINVAGDQYGNCGRDMSGTYRSCEGRDVMCGKIQCLSQASKPMESNAVAIDTTITIEGKRVQCRGTHIYKEEDDLMDPGLVLTGTKCGLNQICFDGQCRNTSFLQVDECAKKCHGNGMCNNNRNCHCFAGWRPPFCNQTGNGGSIDSGPVPEDGSLALVLWICIPLALLAGMALSLAMFFYVFRIRGRQAKTESCPATCPLHKSDSPTKHGVGSTSKQRPQVPMQPKSPPVLYPTLRVEKSQSAASQHHQEQPEGGAAKYSSAISHHSNQDLKGGAGKILHGVSYLQQGGAIKTGYAMRTPPPNRPAPPPPALAPTPPAPVPPPPASAPPPPAPKRLERPRRLPLPPPVPPNRTRRKAMDSSFSGPEGTT

SEQ ID NO: 187 - protein, 317 aa, Xenopus laevis
MGKWLLYVTTLLLFVSPHPSLSNITTAAPPLCGSPVFSSRIVGGTDTRQGAWPWQVSLEFNGSHICGGSIISDQWILTATHCIEHPDLPSGCGVRLGAYQLYVKNPHEMTVKVDIIYINSEFNGPGTSGDIALLKLSSPIKFTEYILPICLPASPVTFSSGTECWITGWGQTGSEVPLQYPATLQKVMVPIINRDSCEKMYHINSVISETEILIQSDQICAGYQAGQKDGCQGDSGGPLVCKIQGFWYQAGIVSWGERCAAKNRPGVYTFVPAYETWISERSVISFKPFTSSSSPSSSSVLRASAILLGVSLLLHDW

SEQ ID NO: 188 - protein, 417 aa, Homo sapiens
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 189 - protein, 1219 aa, Xenopus laevis
MPPLFQALTTALFFCGIASNPLFQPSLVMDMAKVLLDNYCFPENLVGMQETIEQAVKGGEILHISDPDTLANVFTSGVQGYLNDPRLVVSYEPNYSGPQTEQSLELTPEQLKFLINHSVKYDILPGNIGYLRIDFIIGQDVVQKVGPHLVNNIWKKLMPTSALILDLRYSTQGEVSGIPFVVSYLCDSEIHIDSIYNRPSNTTTDLWTLPELMGERYGKVKDVVVLTSKYTKGVAEDASYILKHMNRAIVVGEKTAGGSLDTQKIKIGQSDFYITVPVSRSLSPLTGQSWEVSGVSPCVVVNAKDALDKAQAILAVRSSVTHVLHQLCDILANNYAFSERIPTLLQHLPNLDYSTVISEEDIAAKLNYELQSLTEDPRLVLKSKTDTLVMPGDSIQAENIPEDEAMLQALVNTVFKVSILPGNIGYLRFDQFADVSVIAKLAPFIVNTVWEPITITENLIIDLRYNVGGSSTAVPLLLSYFLDPETKIHLFTLHNRQQNSTDEVYSHPKVLGKPYGSKKGVYVLTSHQTATAAEEFAYLMQSLSRATIIGEITSGNLMHSKVFPFDGTQLSVTVPIINFIDSNGDYWLGGGVVPDAIVLADEALDKAKEIIAFHPSIFPLVKGTGHLLEVHYAIPEVAYKVSSVLQNKWSEGGYRSVVDLESLASLLTSEMQENSGDHRLHVFYSDTEPEILEDQPPKIPSPEELNYIIDALFKIEVLPGNVGYLRFDMMADTEIIKAIGPQLVSLVWNKLVETNSLIIDMRYNTGGYSTAIPIFCSYFFDPEPLQHLYTVYDRSTSTGKDIWTLPEVFGERYGSTKDIYILTSHMTGSAAEVFTRSLKDLNRATLIGEPTSGVSLSVGMYKVGDSNLYVTIPNQVVISSVTGKVWSVSGVEPHVIIQANEAMNIAHRIIKLRTKIPTVIQTAAKLVADNYAFADTGANVASKFIALVDKIDYKMIKSEVELAEKINDDLQSLSKDFHLKAVYIPENSKDRIPGVVPMQIPSPELFEELIKFSFHTDVFEKNIGYIRFDMFADSDLLNQVSDLLVEHVWKKVVDQDALIIDMRFNIGGPTSSIPIFCSYFFDEGTPVLLDKIYSRTSNAMTDIWTLPDLVGKTFGSKKPLIILTSSLTEGAAEEFVYIMKRLGRAYVVGEVTSGGCHPPQTYHVDDTHLYLTIPTSRSASAEPGESWEGKGVLPDLEISSETALLKAKEILESQLEGRR

SEQ ID NO: 190 - protein, 809 aa, Macaca mulatta
MLLLFHSERMPVAKAPQVAGGQGDGGDGEEAEPEGMFEAREDSKRKARGYLRLAPLWLTLVVLTSVGVLLWYFLGYKAEVTVSQVYSGSLRVLNRHFSQDLTRRESSAFRSETAKAQKMLKELIASTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPEDLMLKLRLEWTLAECRDRLAMYDVAGPLEKRLITSVYGCSRQEPVVEVLASGAIMAVVWKKGLHSYYDPFMLSVQSVVFQACEVNLTLDDRLDSQGVLSTPYFPSYYSPRTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCQEDSTCISLLKVCDGQPDCLNGSDEERCQEGVPCGTFTFQCEDQSCVKKPNPQCDGRPDCRDGSDEQHCDCGLQGPSSRIVGGAVSSEGEWPWQASLQVRGRHICGGALIADRWVITAAHCFQEDSMASPALWTVFLGKVWQNSRWPGEVSFKVSRLLLHPYHEEDSHDYDVALLQLDHPVVRSAAVRPVCLPARSHFFEPGLHCWITGWGALREGGPTSNALQKVDVQLIPQDLCSEAYRYQVTPRMLCAGYRKGKKDACQGDSGGPLVCKALSGRWFLAGLVSWGLGCGRPNYFGVYTRITGVIGWIQQVVT

SEQ ID NO: 191 - protein, 1380 aa, Homo sapiens [sequence omitted]

SEQ ID NO: 192 - protein, 685 aa, Xenopus tropicalis
MNKGWLELESDPGLFTLLVEDFGVKGVQVEEIYDLQSKCPGPVYGFIFLFKWIEERRSRRKVSTLLDDTSVMEDEVVNNMFFAHQLIPNSCATHALLSVLLNCSGVHLGPTLSRIKEFTKGFSPESKGYAIGNAPELAKAHNSHARPEPRHLPEKQNGISAVRTMEAFHFVSYVPIKGRLFELDGLKVYPIDHGPWAEDEEWTDKARRVIMERIGLATAGEPYHDIRFNLMAVVPDRRLKYESKLHILKMNRQTVLEALQQLIRVTQPELIQAQKPTEGQSTEETKSAALKAPVSQESHRAHHGSHRNATDVGAEPPGALIRGPVMSAYSKPNSLAQNGGTVAAPASRLPAFLDNHNYAKSPMQEEEDLAAGVGRSRGVPPPAPDTDEEEEEETENVRRPLTPPGFKRRSSEPLPPPPGPEPGVLAEKLKETQRDLCSPLSIKTGAPTAPHSQPSPTPSNESTDTASEIGSAFNSPLRSPLRSANPTRPSSPVTLHLSKVLFGEEEPLLRLDCVRYNRAVRELGPHISTGILHLSKDGYLCPLSRLETGKVSPKGNKVEEPRESSEPDTERSRVTEVPQGEKFSPKELLALLKCVEAEISSSEACLREELEKRKKFKIDDQRRTHNYDEFICAFISMLAQEGMLASLVEQNISVRRRQGVSIGRLHKQRKPDRRKRSRPYKAKRQ

SEQ ID NO: 193 - protein, 1686 aa, Homo sapiens [sequence omitted]

SEQ ID NO: 194 - protein, 613 aa, Xenopus laevis
MNKLCCVLILFCHFYVNTFSSAVSGAGDARPNTCEFNALSCHKVFCAPWQRCVAGVCRCKLPYQCPKNATTEVCTDGKRKLQSYCQLKSVECSNPLNSKYRFSSEAPCTETFTLTQNGEPGKGIIKVKLPTFEQELFLCGKQWSNREANVVCRQLGSTKGADASASDKVFSLVTEKPPEHCIQATCRGLENSLAECALRKLPMQDNQVAKVTCYTENKDCGFGEFTCSNGKCIPSELACDSKNDCGDLSDELCCKSCNAGFHCRSDTCIPEQYRCNGELDCIGGEDESNCTVEQEQKSEKQEEVEQKQTSEKQEEDLVQESKATQVEEKAKIVNYDIDAERRLLMKSLPELSCGVPPQTAALTLTRKKRVIGGTNAVKNQFPWQVAIKDGTAVNCGGIYIGGCWVLTAAHCVRSNQPQRYLIMLELLDRLSYDKDLDSFPVKSVIVHELYNPNTYENDIALLEVKNIYNNPKCMQADNNMVPACVPWSPFQFKAGDTCTVSGWGREKGMSRVFHLKWGHINLMDNCTRVYKERFLDKMECARTYDGSIDACKGDSGGPLVCYDVNKVAYVWGIVSWGENCGVPGYPGVYTKVANYFEWIAHQVGRSLMSKYNV

SEQ ID NO: 195 - protein, 296 aa, Xenopus tropicalis
DWSHLLRALLLLNLGVYVLAGYDNSDYDQDNDDEIDDNDDDNKPTCGTPVKIDNRIVGGQDAMKGKNPWQVIVWIPGSGYCGGALISSNLVVTVAHCIDGFNASSVVVILGAYKITGNPNEENSVPVQQIIIHPSYNESDNSADIALLQLSQNVPITRYIQPVCVPSASTVFPPGQNCVVTGWGDIELSVIPQRPVVLQETQVRLMSTEQCKSYYDNKGVGSFIKDDMICAVDILGQRGPCLGDGGGPLVTYQNKQWNLVGVASFGFGCGNENPAVYTSVRAYIDWIQQYMYPIDD

SEQ ID NO: 196 - protein, 425 aa, Mus musculus
MASSSPDAPCSCDCFVSVPPASAIPAVIFAKNSDRPRDEVQEVVFIPAGTHVPGSRLQCTYIEVEQVGKTHAVILSRPSWLWGAEMGANELGVCIGNEAVWTKEPVGQGEALLGMDLLRLALERSSTAQEAVHVIAGLLDRYGQGGSCREDPEPFCYHNTFLLADRTEAWVLETAGSLWAAQRIQGGARNISNQLSIGTDISAEHPELRSHAKAQGWWTGQGLFDFAEVFSLTQQPVRMEAAKARFRAGCEMLQRHQGNITAEVMMGILRDKESGICMDSGGFRTTASMVSVLPQDPTKPCVHFLTATPDPSRSVFKPFIFEVGVSQSPQVLSPTFGAQDPVRILPRFQTRVDRRHSLYRGHQAALGLMEDEQEQAQQLRKKQQRLEQEGLEALRGLLTGEQTPPAQGLGSLFQAFVEREEQAYA

SEQ ID NO: 197 - protein, 627 aa, Homo sapiens
MCVPRSGLILSCICLYCGVLLPVLLPNLPFLTCLSMSTLESVTYLPEKGLYCQRLPSSRTHGGTESLKGKNTENMGFYGTLKMIFYKMKRKLDHGSEVRSLSLGKKPCKVSEYTSTTGLVPCSATPTTFGDLRAANGQGQQRRRVTSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 198 - protein, 343 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 199 - protein, 267 aa, Xenopus tropicalis
PLLVLVLCLAGAYCCGVPTYQPVVSRVVNGEDVAPHSWPWQVSLQYLYYGYWYHTCGGSLISSNWVLTAAHCISSYNTYRVQLGKHNLRYIEPGQKIINVSKLINHPRWDPNSLGNGFDISLIKLEESVDFSDTVQPACLPPAGYILPHQYGCYVTGWGNIRTGGPEPDILQQGLLLVVDYATCSQWDWWGDGVRTNMICAGGDGITSSCNGDSGGPLNCRNANGTWEVHGVVSFGSAAGCNYPKKPSVFSRVSEFNSWISTTIASN

SEQ ID NO: 200 - protein, 1791 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSERLGEECDDGDLVSGDGCSKVCELEEGFNCVGEPSLCYMYEGDGICEPFERKTSIVDCGIYTPKGYLDQWATRAYSSHEDKKKCPVSLVTGEPHSLICTSYHPDLPNHRPLTGWFPCVASENETQDDRSEQPEGSLKKEDEVWLKVCFNRPGEARAIFIFLTTDGLVPGEHQQPTVTLYLTDVRGSNHSLGTYGLSCQHNPLIINVTHHQNVLFHHTTSVLLNFSSPRVGISAVALRTSSRIGLSAPSNCISEDEGQNHQGQSCIHRPCGKQDSCPSLLLDHADVVNCTSIGPGLMKCAITCQRGFALQASSGQYIRPMQKEILLTCSSGHWDQNVSCLPVDCGVPDPSLVNYANFSCSEGTKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYECTNGFSLDSQCVLNCNQEREKLPILCTKEGLWTQEFKLCENLQGECPPPPSELNSVEYKCEQGYGIGAVCSPLCVIPPSDPVMLPENITADTLEHWMEPVKVQSIVCTGRRQWHPDPVLVHCIQSCEPFQADGWCDTINNRAYCHYDGGDCCSSTLSSKKVIPFAADCDLDECTCRDPKAEENQ

SEQ ID NO: 201 - protein, 970 aa, Homo sapiens
MDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 202 - protein, 2527 aa, Canis familiaris
MQAGSIQDSLAKDVTKNDENGNCSGEGIEFPTTNLYELESRVLTDHWSIPYKREESLGKCLLASTYLARLGLSESDENCKRFMDRCMPEAFKKLLTSSAVHKWGTEIHEGIYNMLMLLIELVAERIKQDPIPTGLLGVLTMAFNPDNEYHFKNRMKVSQRNWTEVFGEGNMFAVSPVSTFQKEPHGWVVDLVNKFGELGGFAAIQAKLHSEDIELGAVSALVQPLGVCAEYLNSSVVQPMLDPVILTTIQDVRSVEEKDLKDKRLVSIPELLSAIKLLCMRFQPDLVTVVDDLRLDILLRMLKSPHFSAKMNSLKEVTKLIEDSTLSKSVKNAIDTDRLLDWLVENSVLSIALEGNIDQAQYCDRIKGIIELLGSKLSLDELTKIWKIQSGQSSTVIENIHTIIAAAAVKFNSDQLNHLFVLIQKSWETESDRVRQKLLSLIGRIGREARFETTSGKVLDVLWELAHLPTLPSSLIQQALEEHLTILSDAYAVKEAIKRSYIIKCIEDIKRPGEWSGLEKNKKDGFKSSQLNNPQFVWVVPALRQLHEITRSFIKQTYQKQDKSIIQDLKKNFEIVKLVTGSLIACHRLAAAVAGPGGLTGSTLVDGRYTYREYLEAHLKFLAFFLQEATLYLGWNRAKEIWECLVTGQDVCELDREMCFEWFTKGQHDLESDVQQQLFKEKILKLESYEITMNGFNLFKTFFENVNLCDHRLKRQGAQLYVEKLELIGMDFIWKIAMESPDEEIANEAIQLIINYSYINLNPRLKKDSVSLHKKFIADCYTRLEAASSALGGPTLTHAVTRATKMLTATAMPTVATSVQSPYRSTKLVIIERLLLLAERYVITIEDFYSVPRTILPHGASFHGHLLTLNVTYESTKDTFTVEAHSNETIGSVRWKIAKQLCSPVDNIQIFTNDSLLTVNKDQKLLHQLGFSDEQILTVKTSGSGTPSGSSADSSTSSSSSSSGVFSSSYAMEQEKSLPGVVMALVCNVFDMLYQLANLEEPRITLRVRKLLLLIPTDPAIQEALDQLDSLGRKKTLLSDTSSQSSKSPSLSSKQQHQPSASSILESLFRSFAPGMSTFRVLYNLEVLSSKLMPTADDDMARNCAKSFCENFLKAGGLSLVVNVMQRDSIPSEVDYETRQGVYSICLQLARFLLVGQTMPTLLDEDLTKDGIEALSSRPFRNVSRQTSRQMSLCGTPEKSSYRQLSVSDRSSIRVEEIIPAARVAIQTMEVSDFTSTVACFMRLSWAAAAGRLDLVGSSQPIKESNSLFPAGIRNRLSSSGSNCSSGSEGDPAALHAGICVRQQSVSTKDSLIAGEALSLLVTCLQLRSQQLASFYNLPCVADFIIDILLGSPSAEIRRAACDQLYTLSQTDTSAHPDVQKPNQFLLGVILTAQLPLWSPTSIMRGVNQRLLSQCMEYFDLRCQLLDDLTTSEMEQLRISPATMLEDEITWLDNFEPNRTAECETSEADNILLAGHLRLIKTLLSLCGAEKEMLGSSLIKPLLDDFLFRASRIILNSHSPAGSAAISQQDFHPKCSTVNSRLAAYEVLVMLADSSPSNLQIITKELLSMHHQPDPALTKEFDYLPPVDSRSSSGFVGLRNGGATCYMNAVFQQLYMQPGLPESLLSVDDDTDNPDDSVFYQVQSLFGHLMESKLQYYVPENFWKIFKMWNKELYVREQQDAYEFFTSLIDQMDEYLKKMGRDQIFKNTFQGIYSDQKICKDCPHRYEREEAFMALNLGVTSCQSLEISLDQFVRGEVLEGSNAYYCEKCKEKRITVKRTCIKSLPSVLVIHLMRFGFDWESGRSIKYDEQIRFPWMLNMEPYTVSGMARQDSSSEVGENGRSMDQGGGGSPRKKVALTENYELVGVIVHSGQAHAGHYYSFIKDRRGCGKGKWYKFNDTVIEEFDLNDETLEYECFGGEYRPKVYDQTNPYTDVRRRYWNAYMLFYQRVSDQNSPVLPKKSRVSVVRQEAEDLSLSAPSSPEISPQSSPRPHRPNNDRLSILTKLVKKGEKKGLFVEKMPARIYQMVRDENLKFMKNRDVYSSDYFSFVLSLASLNATKLKHPYYPCMAKVSLQLAIQFLFQTYLRTKKKLRVDTEEWIATIEALLSKSFDACQWLVEYFISSEGRELIKIFLLECSVREVRVAVATILEKTLDSALFYQDKLKSLHQLLEVLLALLDKDVPENCKNCAQYFFLFNTFVQKQGIRAGDLLLRHSALRHMTSFLLGANRQNNQIRRWSSAQAREFGNLHNTVALLVLHSDVSSQRNVAPGLFKQRPPISVAPSSPLLPLHEEVEALLFLSEGKPYLLEVMFALRELTGSLLALIEMVVYCCFCNEHFSFTMLHFIKNQLETAPPHELKNTFQLLHEILVIEDPIQVERVKFVFETENGLLALMHHSNHVDSSRCYQCVKFLVTLAQKCPAAKDYFKENSHHWSWAVQWLQKKMSEHYWTPQSNVSNETSTGKTFQRTISAQDTLAYATALLNEKEQSGSSNGSESSPANENGERHLQQGSESPMMIGELRSDLDDVDP

SEQ ID NO: 203 - protein, 2505 aa, Homo sapiens
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 204 - protein, 514 aa, Xenopus tropicalis
MTTGTLELRGLQRSFGLVRALRSFTHTFAAGQIHALIGKNGSGKSTFVKIVAGAIPASAGEMLLDGVALNFAQPGDAIAAGIVTIHQEMSLAPDLSVAENIYLGRLPRRSGALRWMVDWATLHRQAACLLAQMGAADIAPAALVSTLSVGQQQVVEIAKAMSLSPKLLQLDEPTSALAQHEVEHLFALLQRLRNQGVTMVYISHRLSELQQIADTVTVLRDGEYIGSVPISEASPRAVLDMMFGQVEQASRPQRARPDDAPVLAVEHLRIEGLLQDVSFELRVGEVLGIAGMLGSGRTELLQAIFGARPFDGGCIRVRDEHVPRPTIAGMKARGLGYASEDRKRAGLVQAGSVHANLCLSALQRIAPSGLTSLQRERPHVARQIQELGIKVSSAALPVSSLSGGNQQKVVVGNWLNNRPAIMLFDEPGRGVDVHAKQQINQIIWSQAAAGMSSIVVSTELEDLVECCDRILHPPRIHQPLRVERVLDGAHHAQRHGRLVSLQFANLQPAYAVLG

SEQ ID NO: 205 - protein, 1362 aa, Xenopus laevis
  misc_feature (138)..(138): Xaa can be any naturally occurring amino acid
MGQGVLRGEGHPNNNPNSKVGWKSLVGIITIFMLILCDQSDGKICYSMDIRNNISQFSMLEDCTVIEGHLQILLMFTSKPENFRGLRFPKLTTITDYLLLFRVYGLESLKDLFPNLTVIRGTRLFFNYALVIFEMVHXKEIGLYNLMNITRGSVRIEKNNELCYLSTIDWSIILDSVEDNYIELNRDNKEECGDVCPGTVKGKSKCKHTLVNGALVERCWTQDHCQKVCPSDCKGSGCLPDGQCCHPECLGSCRKPNDPSECTACRHFQNEGVCVTACPKGSYQFQGWRCIDFNTCQELNSRCQNSRDNSCPPYVIHKGECMPDCPSGYIANSTTRTCTPCAGPCPKVCTIFQNVKTIDSVTSAQELRGCTVINGSLIINLRGGNNIATELEANLGLIEEISGYLKIRRSYALVSLSFFRKLRLIRGEVLEAGNYSFYALDNPSLRQLWDWHKHNLTIIHGKLFFHHNPRLCLSQIHQMEEVTGTKGRQDKNDIATKTNGDQASCEDNLLTFNFIKTSHDMVLLRWDAYWPPDYRDLLGFMVHYKEAPFQNVTEFDGQDACGSNSWTVVDMDAPERSADGKTQSPGCLLRSLKPWTQYAVFVKTLVSGSDEGRTYGAKSKIIYIRTNETIPSVPLDPFSVSNSTSQIILKWKPPSEPNGNVTHYLVYWQEQPEDSDLYEVDYCNKGLKLPSRTWTPPTEIDENGNENQTEHTSVNKCCPCPKTEFQIQKEQDESAFRKTFENYLHNEVFIPRPVRKRRDLFGVANGTLPDPVTAPPLFNVSSTRAPDEPEPKIYSQKVWFKESVLISGLKHFTGYRIEIHACNHELSMGCSVAAYVNARTMPEATADKVVGPITYEYVEPNIIHLKWQEPKDPNGLIVLYEVHYSRVGGIEEVITCVSQKQYNTDKGGKLRVLTPGNYSVKIRATSLAGNGSWTEQAYFQVPDHPHSNIVKIITGPIIAVFLLLIVLVYCVVQKKKDAEGPAGPLYTSSNPEYLSASEVYIPDEWEVPRDKINLLRELGQGSFGMVYEGIAKDIIKGEPEVRVAVKTVNESASLRERIEFLNEASVMKAFNCHHVVRLLGVVSKGQPTLVIMELMAHGDLKSYLRSLRPDAENNPGRLAPTLKEIIQMAAEISDGMAYLNAKKFVHRDLAARNCMVADDYAVKIGDFGMTRDIYETDYYRKGGKGLLPVRWMSPESLKDGVFTAFSDVWSFGVVLWEITSLAEQPYQGLSNEQVLKFVMDGGSLDHPENCPPRLHSLMQMCWQYNPKMRPTFLEIIDMLKDDLRPSFQDVSFYYSDENKPPETDDLEIDFENMESTPLDPSSCSLRDQSSRTNIYEEHIPYTHMNGGRKNGRILSLPRSSPS

SEQ ID NO: 206 - protein, 831 aa, Xenopus tropicalis
MAAPSIKFKTNYAVTRKIEAFYKGGKVQINSDGTYILCTCGNKLNILDIATGAVTYTIEQDDQEDITSFALSPDDEILVTGSRALLLKQWDWKQGTCSRTWKAIHTAPVATMTFDPTSTLLATGGCDSTIKIWDVIKQYCTHNLKGSSGVVHLVQFHPDMSRLQLFSSSMDYKIRLWDLKTSKCLCVMETHFSAVTSLCFSPDGNTMISSGRDKICTMWDLETKSPKRTVPVYESVEAVVLFPDSSDIICQENDSQSLLFLTAGSKGILRVWDAATAVCVYGQTLPHIAEGNSTEEEANEHSLTHCLLIPGQHQVATITAEHNILMYDLQNLQLKKQFAGYNDEVLDVKFLGPSDSHIVVATNSPQLKVFDLETSNCQILYGHTETVLALDVFKKGLLFASCAKDRTIRVWRMKKATGKVTCVAQGSGHTNGVGTISCSRMKEAFLVSGSQDYTIKLWKLPESLANKQSKGNSGDLETLLACATEKAHDKDINSVTVSPNDKLIASGSQDKTAKLWLATDLSLLGVFRGHKRGIWCVQFSNVDQVLASTSADGTLKLWGLQDFSCLKTFEGHDASVLKVVFVSRGAQLLTSGSDGLLKLWTIKTNECVKTLDTHEDKVWGLHCNREDDALVTGSADSAIILWKDVTETELAEEQAKEDEAILKQQELSNLLHEKRFLKALGLAISLDQPHTVLTVVKAILQEPHGKDDLEKNIERLRQDQKESILRYCCVWNTNSRNCHEAQSVLSIILTHEPPESLLQFSGIRGSLESLIPYTERHMQRMGRLLQASMFVDFMWQHMRLTDLPEEDKAPGSIATKSAPVAEKNKIPSVQG

SEQ ID NO: 207 - protein, 1530 aa, Xenopus laevis
MLPSFVKKKMCYIGFWKLSISLGLVLVILSEVAPQPCPSQCSCTGTTVDCHGLSLRSVPRNIPRNAERLDLNANNITRISKTDFAGLRHLRILQLMENKITTIERGAFQDLKELERLRLNRNNLQVFPELLFLGTPKLYRLDLSENQIQAIPRKAFRGAVDIKNLQLDYNQISCIEDGTFRALRDLEVLTLNNNNITRLSVASFNHMPKLRTFRLHSNNLYCDCHLAWLSDWLRQRPRVGLYTQCMGPIHLRGHNVAEVQKREFSCTGQQSFMVHSCSVLHCPAACTCSNNIVDCRGKGLTEIPTNLPETITEMRLEQNSIKVIPPGAFSPYKKLRRIDLSNNQISEIAADAFQGLRSLNSLVLYGNKITELPKGLFEGLFSLQLLLLNANKINCLRVDSFQDLHNLNLLSLYDNKLQTIAKGTFSPLRAIQTLHLAQNPFICDCHLKWLADYLHTNPIETSGARCTSPRRLANKRIGQIKSKKFRCSGTEDYRSKLSGDCFADLACPEKCRCEGTTVDCSNQKLTKIPDHIPQYTAELRLNNNEFTVLEATGIFKKLPQLRKINLSNNKITDIEEGAFEGANGVNELLLTSNRMENVRHKMFKGLEGLKTLMLRSNHISCVNNDSFTGLSSVRLLSLYDNQITTVAPGAFDTLHSLSTLNLLANPFNCNCHLAWLGDWLRKKRIVTGNPRCQKPYFLKEIPIQDVAIQDFTCDDGNEDNSCSPLSRCPAECTCLDTVVRCSNKGLKSLPKGIPKEVTELYLDGNVFPLVPKELSNYMHLTLIDLSNNQISTLSNHSFSNMTHLLTLILSYNRLRCIPLRAFDRLKSLKLLSLHGNDVSAIPEGAFSDLSALSHLAIGANPLYCDCKMQWLSDWVKSEYKEPGIARCSGPGEMADKLLLTTPSKKFSCNGPVDVNILAKCNPCLSNPCKNNGTCNNDPVEFYRCTCPYGFKGQDCDVPIHACISNPCHNGGTCHLKEGDKEGFWCACTDGFEGENCEVNIDDCEDNDCENNSTCVDGINNYTCRCPPEYTGELCEEKLDFCSQDINPCQHDSKCIQTLKGYKCDCTPGYIGEHCDIDYDDCLENKCRNGARCVDAVNGYTCTCPEGYGGLFCESAPPMVLPRTSPCDNFECQNGAQCIVKGNDLLCQCLPGYRGNKCEKLVSVNFVNKDSFIPIPSTKIRAQANITLQVATDEDSGILLYKGDKDQVAVELYRGRVRVSYDTGSNPSSAIYSVETINDGNFHVVELVNLDQTLSLIIDGGTPKSITNLPKQSLLSVDSTLYIGGMPMKNNIAGLRQSSSQNGTNFQGCIRNLYINDELQDFRKLNLQPGVLPGCEPCHKNVCVHGTCLATSQAGFTCECEGGWTGQLCDIQSNDPCLGNKCVHGTCLPINSFSYSCKCLQDFVGVLCDEAEDQPNPCQSIKCKHGKCRLSGLGKAYCECSSGYTGDNCDKEISCRGERIRDYYQRQQGYAACQTTEKVSRLECKGGCSNGQCCGPLRSKRRKYAFECTDGSSFVDEVEKIIKCGCTKCPS

SEQ ID NO: 208 - protein, 343 aa, Canis familiaris
MGFQCRGGKRDIGSAGPNSQKMSITNDSAIREFILLGLTDRPELQPLLFVLFLGVYLVTLLGNLGMMVLIRLDSRLHKPMYFFLTNLAFVDLCYTSNATPQMLTNFLSEKKTISFAGCFTQCYIFIALLLTEFYMLAAMAYDRYVAICNPLHYSMKMSRRVCIGLATFPYVYGFSDGLLQAILTFRLNFCRSNVINHFYCADPPLIKLSCSDTYVKEHAMLISAGFNLSNSLSIILVSYAFIIAAILRIKSAEGRQKAFSTCGSHMMAVTLFYGTLFCMYVRPPTDKTVEESKIIAVFYTFVSPVLNPLIYSLRNKDVKQALKNVLRRNMIIKMRLPPVSNKS

SEQ ID NO: 209 - protein, 345 aa, Homo sapiens
MVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKVALLNDCVCDGLERPICESVKENMARLCFGAELGNGPGSSGSDGGLDDYYDEDYDDEQRTGGAGGEQPLDDDDGVPHPPRPGSGAAASGGRGDLPYGPGRRSSGGGGRLAPRGAWTPLASILLLLLGPLF

SEQ ID NO: 210 - protein, 742 aa, Macaca mulatta
MADFLSQSEPLASQELSGDFKKPALLVPAAARSKAPATSSSNPEEVQKEGPTALQDPSSGEPDVPPPQPDCGDFRSLQEEQSRPPTAVSSSGGPARAPPYQEPPWGGPATAPYSLEILKGGAILGTRSLKGTSYCLFGRLSGCDVCLEHPSVSRYHAVLQHRASGPDGECDSNGPGFYLYDLGSTHGTFLNKTRIPPRTYCRVHVGHVVRFGGSTRLFILQGPEEDREAESELTVTQLKELRKQQQILLEKKMLGEDSDEEEEMDTSERKINAGSQDDEMGCTWGMGEDAVEDDAEENPIVLEFQQEREAFYIKDPKKALQGFFDREGEELEYEFDEQGHSTWLCRVRLPVDDSTGKQLVAEAIHSGKKKEAMIQCSLEACRILDTLGLLRQEAVSRKRKAKNWEDEDFYDSDDDTFLDRTGLVEKKRLNRMKKAGKIDEKPETFESLVAKLNDAERELSEISERLKASSQVLSESPSQDSLDAFMSEMKSGSTLDGVSRKKLHLRTFELRKEQQRLKGLIKIVKPAEIPELKKTESQTTGAENKAKKLTLPLFGAMKGGSKFKLKTGTVGKLPPKRPELPPTLMRMKDEPEVEEEEEEEEEEEKEKEEHEKKKLEDGSLSRPQPEIEPEAAVQEMRHPTDLTHFKETQTHENMSQLSEEEQNKDYQDSSETTSLCEGPSASKNEYEKSRDELKKKKAPGPGKLPPTLSSKYPEDDPDYCVWVPPEGQSGDGRTHLNDKYGY

SEQ ID NO: 211 - protein, 75 aa, Danio rerio
MKGDTPVNSTMSVGQARKLVEQLKIEASFCRIKVSKAAADLMAYCDAHACEDPLITPVPTSENPFREKKFFCALL

SEQ ID NO: 212 - protein, 1447 aa, Homo sapiens
MAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASQNKPLWQCYLGRFNDIHVPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQRAESPESSAIESTQSTPQKGRGRPSKTPSPSQPKKNVRVGRSKQAATKENDSSEEVDVFQGSSPVDDIPQEETEEEEVSTVNVRRRSAKRERR

SEQ ID NO: 213 - protein, 324 aa, Xenopus tropicalis
MVGYDPSTDGRLLSSSEVAMAGSLSGLVTRALISPLDVIKIRFQLQIESLSSHGTQGKYHGILQAVGLILREEGLPGFWKGHVPAQLLSVSYGAVQFVSFEMLTELFHVSTSLDPRSPAVHFLCGGLAACSATLAVQPLDTLRTRFAAQGEPKVYRNLRNAIFTMFRTEGPVAFYRGLFPTLLAVFPYAGLQFSSYNLLKRTWNLVLLKDQTQKDSLRNLLCGSGAGVISKTVTYPFDLFKKRLQVGGFEQARAHFGKVRTYHGLVDCACQIWKEEGFRGFFKGLAPSLLKAAFSTGLTFFSYELFCSLMLSAKKAKKRKRKED

SEQ ID NO: 214 - protein, 623 aa, Macaca mulatta
MRVALGMLWLLALGWPPQARGFCPSQCSCSLHIMGDGSKARTVVCNDPDMTLPPASIPPDTSRLRLERTAIRRVPAEAFRPLGRLEQLWLPYNALSELNALMLRGLRRLRELRLPGNRLATFPWAALRDAPELRLLDLQANRLSAVPPEAARFLENLTFLDLSSNQLMRLPQELIISWAHLKTGIFPHSHHPRLVLGLQDNPWACDCQLYDLVHLLDGWAPNLAFIETELRCASPRSLAGVAFSQLELRKCQGPELHPGVANIRSPLGGTALLRCGATGVPGPEMSWRRANGRPLNGTVHEEVSSDGTSWTLLGLPAVSHLDSGDYICQAKNFLGASETVISLIVTEPQTSTEHSGSPGALWARTGGGGEAAAYNNKLVARHVPQIPKPAVLATGPSVPSSKEELTLQHFQMDALGELSDGRVGPSEARVVRSVKVVGDTYHSVSLVWKAPKAKNTTAFNVLYAVFGQHSMRRVIVQPGKTRVTITGLLPKTKYVACVCVQGLVPRKEQCVIFSTNEVVDAENTQQLINVVVISVAVVIALPLTLLVCCGALQRRCRKCFNRDSTEATVTYINLERLGHSEDGLEELSRHSVSEADRLLSARSSVDFQAFGVKGGRRINEYFC

SEQ ID NO: 215 - protein, 4742 aa, Gallus gallus
MTISRVQNDDWVPCEAVGLRLTCLFYPRDLIGCGGGQFRCGNGRCIPADWRCDGARDCSDDTDEAGCPQPTCEGNQFQCQTDGECIPHSWVCDDEEDCEDGSDEHQQCPGRTCSSQQFTCSNGQCIPSAYRCDRVKDCTDGTDERDCRYPRCEQLSCANGACFNASQRCDGKVDCRDTSDEANCTRGCASTQFQCANGECIPQAFMCDHDDDCGDRSDENSCTYATCRGNFFTCPSGRCIHQSWICDGDDDCEDNEDERGCESSYHECYPGEWACPESGHCIPIGKVCDGAADCPAGEDETNITAGRHCNISHCAALSCQYRCHSSPSGGMCYCPSGYTISSNDSRTCIDFDDCKMWGVCDQLCEDRVGHHQCHCVEGYFLEHHRHCRANTSAGVASIIFSNGRDLLIGDLHGRNFRTLVQSQNRGVAVGVDFHFYLHRIFWTDTVQDKVFSINIDGSDFQEVLNVSVDTPENLAVDWVNNKLYVVETSVNRIDMVNLDGTNRVTLIAENLGNPRGIALDPTVGYLFFSDWDSLSGDPKVERAFMDGTNRQDLIKTKLGWPAGITLDIVSKRLYWVDSRFDYIETVTYDGLQRRTIAHGGSLIPHPYGITLFEHNVYFTDWTKMAVVKANKFSESNPQVIYQSSLRPYGVTVYHAARQPYVRNPCGNNNGGCEQICVLSHKTDNDGLGYRCRCILGFDLHVDGRHCVAVQQFLLFSSQLAVRGIPFNLSTQEDVIIPVTGSPSYFVGIDFWAQDDTIFFSDTSRDMIYKQKTDGSGREILTANRVESVEDLAFDWISKNLYWTDPRYRSISVMRLADKSRRAIVQNLNNPRSIVVHPVIGYIFWTDWFRPAKIMRAWSDGSHGLPIVNTTLGWPNGLAIDWSSLRLYWVDAFFDKIEHSTFDGLDRRTLERVAQMTHPFGLTIFGGYAYFTDWRLGAIVRVRKSDGGEMTIIRRGISNIMHVKAYDAHSQIGSNYCNRGTNPNGDCSHFCFPVPNFQRVCGCPYGMKLGSNQLTCVEDPSNEPPTLQCGSYSFSCNNGRCVPRYYQCDGIDDCHDNSDEQNCGSLNNTCSSSAFTCANGQCIPSRWRCDKHNDCFDGSDELRCPTQGPTSCPETLFTCDNNRCIPRIWLCDTDNDCGDGSDEKNCTFTGTCEPRQFQCPDHRCIDPYYVCDGDKDCVDGADEHDCIYNCSGTEFKCVSGDQCISSYYQCDGVFDCNDHSDETDCPTRPPGMCHQNEFQCQSDGNCIPANWECDGHLDCADGSDEHHRCPARTCPPSLFRCDNGNCVYRAWICDGDNDCRDMSDERDCPTQPFRCPSWQWQCPGHSICVNLSKVCDNSADCPNGADESPLCNQESCSDNNAGCTHECIQGPFGAQCTCPVGYQLTNDSKTCEDINECDPPGFCSQHCYNERGSFRCYCDEGYILETNGRTCKVAESGNLLLLVASRNQIVVDNITSQSHSIYSLIRDGRNIVAIDFDSISDRIFWSDTTQDKIWSAYQNGTDRKVVFDSGVTVTESIAVDWVGRNLYWTDFVLETIEVSKMDGSHRTVLISENVTNPRGLVLDPRIDAHVMFWTDWGQNPRIEKASMDGKLRTVIISSKIYWPNGLSIDYPNKLLYFADAYLDYIDFCDYNGNNRRQVVASDLVLQHPHGLTIFEDFVYWSDRYTNRVIRANKWHGGNQTVMIYNIHQPLGLVAVHPVKQPYGINSCASSPCSHLCLLSSSGPLFFSCACPSGWMLSPDNRNCMRVEHPFLIAVRDNIIYGISLNPEEKTNDAMVPIAGVQNGVDVDFDDSEQMIYWVENPGEIHRVRSDGSNRTVFAPAAVIGAPIGLALDWISANLYYSNPGTQSIEVLKLHGEVMYRKTLITNDGTSLGAGTPIGLTVDPARGKLYWTDQGTDSGVPAKVASANMDGSGIQTLFTGNLDHVEFITIDIKEQKLYWAVTSTGVIEKGNVDGTNRVTLVIHLSHPWGIAVYDTFLYYTDRDYEVIERVDKFTGANKVVLRDNVPRLKCLRVYYRDNSAGSSNGCSNNIGVCQHLCLPVPGGLFSCACATGFQLNPDNRTCSPYNSFVIVSMLSAIKGFSLETSDHSEAMVPLAGRGRNVLHVDVHMPSGFIYWCDYSSTVSSQNAIRKIKPDGSYFRNVVTNGIGRNGIRGIAIDWVAGNLYFTNAFLTETFIEVLRLNTTYRRVLLKTTIDMPRHIVVDPKNRYLFWADYGQNPKIERSFLDCTNRTVLVSEGIVTPRGLAIDHSNGYVYWVDDSLDMIARIQPDGGDVEIVRYGSRYPTPYGITIFGNSMIWVDRNLKKVFQASKEPGNTDQPTVIRDNINWLRDVTIYNSHFQSRSPLDVNNNPCLNNNGGCFHLCFALPDVQTPQCGCAFGTLDSDGKRCTISTDDYLIFALENALRSIHLDPENHSPPFRAVNVLRTAVALDFDSINNRIYFTQSYPSRAGRISYISIYSGIGTPIVVASDLGTPDGIAFDWINNRVYYSDYLNQTISSMAVDGSNRTVIARVPRPRAVVLDPCRGYMYWTDWSSNAKIERATLGGNFRTPIVSTNLVWPNGLTLDYEEQQLYWADANLQKIERCTLTGTNREVIVSTALHPFAMTLFDQHIYWTDWNTRSIYRANKYDGSDQIVMIMNLPQRPMDIHVWAKSKQQQCTNPCNQFNGGCSHICAPGPAGAECQCPSEGRWYLANNNKHCIVDNGTRCDTGFFTCLNGHCISERWKCDNDNDCGDGSDELESVCAFHTCQPTAFTCGNGRCVPYHYRCDHYNDCGDNSDEAGCLFRTCDSHTEFTCNNGRCISLQYVCNGVNNCYDNGTSDERNCPERTCQSGFTKCQSTNICIPRTYLCDGDNDCGDMSDESPTHCVSMTCTNNEFRCTSGRCIPAHWYCDQGVDCADGSDEPASCEPHVRTCSSDQFRCDDGRCIPATWICDGDNDCGDMSDEDQRHSCANRSCTATEFTCANNRPPLRRCIPRAWVCDGDADCSDALDEHQNCTRRSCTENEFTCNNGLCIRSAYRCDRRNDCGDASDERGCIYEPCQQHQFTCQNGRCISKAYICDGDNDCGDESDELEHLCSTPEATCSPQHFKCDNGNCIEMAKVCNRLDECLDNSDEKGCGINECSDPSISGCDHVCTDTQTSFYCSCHPGYKLMSDKRTCDDIDECNETPSVCSQICENTAGSYICKCAPGYIREPDGKSCRQNSNISPYLIFSNRYYLRNLTADGQSYSLILQGLRNVVALDFDRVEKRLYWIDVGRKVIERMFLNGTNKEAVISDDVPNGEGIAVDWVGRKLYWVDAYKDCIYVSELDGRFQKKLVDRCVDINNTYCFQHPRAIVVHPKYGQVYWTDWADRAYIGRAGMDGKEKMVIISTKLEWPNGLTIDYTNDKLYWADAHLNYIEYSDLDGHHRHTVYDGTLPHPFAITIFEDTIYWTDWNTRTVEKGNKYDGSGRTVLVNTTHRPFDIHVYHPYRQPFVNNPCGTNNGGCSHLCLIKAGGQGYSCECPDNFMIVQFGSTAHCLPMCSSTQFLCADTERCIPIWWKCDGQRDCRDGSDEPPTCPHRYCPVGQFQCNDGNCTSPHFLCNTQPDCHDRSDEDPVLCGEDSTVSFLEKLGDLMSLWEMHPVALEICTSTGQPIYILSANHQCETHQWQCANKRCIPEAWQCDREDDCGDNSDEDTTHCASRTCPPGQFKCDNGRCIPESWKCDVDDDCGDNSDEPFHECMGPAYRCDNHTQFSCRTSYRCIPLWAVCNGNDDCRDNSDEQGCEEMTCSPFGDFRCDNHRCIPLRWKCDGDNDCGDQSDEHNCSPRECTESEYRCDNLRCIPSRWVCDHDDDCEDNSDERDCELRTCHPGYFQCNSGHCVAERFRCDGNADCLDFSDEITCPTRYPNGTYCPPMMFECKNHVCIQPYWKCDGDNDCGDDSDEELHLCLDIACESPFRFRCENNRCIYSHELCNQEDDCGDGSDEKEEHCREPTPRPCTTEEFKCSNGNCIPLHYVCDNYDDCGDHFDEMGCNPGTERTCAENICEHNCTNLNEGGFICSCRPGYKASENNRNSCDDINECEIFGTCTQDCKNSKGSYECFCADGFKSVGDQQGKQCAANGNPPLLLLPDNVRIRRYNISSEQYSDYIDNQERIQALDYDWDPEGIGLSIVYFSILAQGSQFGAIKRAYLPTFDSSRNNPTKEVDLNLRYIVNPDGLAVDWVGRHLYWTDAGTNRIEVAKLDGRYRKWLIFSLLDQPAAIAVNPKHGLMYWTDWGRQPKIECAWMDGQQRRTLVSEDLGWPTGLSIDYLNNDRIYWSDSKENIIESMRHDGTDRTVVLHGEVGSPYSLDVFEGHLYWIAKERGEVWKKDKFGNGEKVKVLTVNPWLTQVRIYHQHRYNQSVPNPCKDVCSHLCLLRPGGYTCACPQGTRFVEGSSTECDAAIESPPTMPPACRCMYGGTCYIDESGLPKCKCSYGYTGDYCEIGLSKGVPPGTTAVAVLLTVILIIIIGVLAVGGFFNYRRTGSILPALPKLPSFAGIWQQQWCSNFIEFLISSNGQRTVVKLSTFRISVLIRSNVEVCLLDLVLDIQFKRMQKVIVSLSSLVKSAENGNGVTFRSGADVSMDIGGSVFEGDSAIDRAMQMNENFAVESGKQPITFENPMYATRDSGAGGTSEVTVIQPTQVTGAGSVENENFENPVYASEVSPGPKEPPPRTDTPQMEKEQQQDTENVPPSSPSLPPKITLKRDQPLAYTATEDTFKDTANLVKEDSVV

SEQ ID NO: 216 - protein, 351 aa, Gallus gallus
MAGAERAVFCCSSRISHGFVYDLKAGELMQLLEDIAAFLEESASTRNLPVSVERFLFCSREGHLVKHHTVGRAEIRQKGLREAPSRPLHLYDTPYEPVSGGLDVDTDCPACPRPRESRLPEDDERPPEEYDQPWEWKKERISKAFAVEIKVIKDLPWPPPVGQLNSGETPPDGEASASVPPQHGPQSYEDANGPSEGLGYGRTSPCREEKARTALRHGTSSLKSTKTLSVEPGPFLGERIDPALPLESQCWYHGAISRTDAETLLRLCKEASYLVRNSETSKNDFSLSLKSSQGFMHMKLSRTQENKYVLGQHSPPFDSVPEIIHHYASRKLPIKGAEHMSLLYPVAIRTL

SEQ ID NO: 217 - protein, 590 aa, Macaca mulatta
MLLLPLLLPVLGAGSLNKDPSYSLQVQKQVTVQEGLCIMVPCNLSYPWDGWNESTAAYGYWFKEGTNTNTGAPVATNNPSREVEMSARGRFQLTGDPGKGSCSLVIRDAQREDEARYFFRVERGTHVRYNFRNNGFLLQVTALTQKPDVYIPETLEPGQPVTVICVFNWASEECPAPSFSWTGTALSSQGTKPTTSHFSVISFTPSPQDHDTDLTCHVDFSRKGVSAQRTVRLRVAYAPRDLVISISRDNTSALKPQENLTHLEARKGQFLRLLCAADSQPPATLSWVLQDRVLSLSHPWGPRTLGLELPGVKAGDSGRYTCRAENRLGSQQRALDLSVQYPPENLRVMVSQANRTVLENLGNGTSLPVLEGQSLRLVCVTHSSPPARLSWTQGGQTVGSSQPSDPGVLELPRVQVEQEGEFTCHAQHPLGSQHISLSLTVHRKLQRGGGVGLGTALGAGVTALLALCSCLVIFGVKTCRKEARKRAAAEQDVPSTLGPISQGQQHECSAGSSQDHLPPGAATPTPGQGEEQEVYYASLSFQGMRLREPEDQEAPSSTEYSEIKIHKGQPPRGLGSGLQLEKETLGMVPK

SEQ ID NO: 218 - protein, 289 aa, Gallus gallus
AAQALGRALVSAKWLSEAVRAGRVGAGLRVLDASWYPPEERDARQEFKERHIPGASFFNIEECRDKSSPYDFMLPSEAHFADYVGRLGVSNDTHVVVYDGDELGTFYAPRAWWMFRAFGHREVSVLNGGFKNWVKEGHPVTAEPSQPAEAVFKAKLDKTLLKTFEQAMENVGSKKFQVVDSRPAGRFQGTELDQGLESGHIPGAVNMPFSTFLTESGHEKSIEEIQQMFREKKVDLSKPLTATCRKGVTACHIALAAYLCGKPDVAVYDGSWSEWFHRAPPQYKVTELK

SEQ ID NO: 219 - protein, 417 aa, Rattus norvegicus
MSAEQDKEPIALKRVRGGDSGLDGLGGPNIQLGSPDKKKRKASTQGASFPPLSEYAPPPNPNADHLVAANPFDDSYNTISYKPLPSSNPYLSPGYPGFGGYSTFRMPPHVPPRMSSPYCGPYALRNQPHPFPQNPLGMGFNRPHAFNFGPHDNSNFGNPPYNNVLTQDINMPSQHFRQGSAENFSQIPPQNVGQVSNPDLASNFAPGNNSNFNSPLESNHSFIPPPNSFGQAKAPLPKQDFTQGAAKTTNQNSSTHPPHLNMEDPVNQSNVELKNVNRNNVVQENSRSGSAEPTNNHANGTQNKPRQPRGAADLCTTDKSRKFSLHPSRHGHSSSDPVYPCGICTNEVNDDQDAILCEASCQKWFHRICTGMTETAYGLLTAEASAVWGCDTCMADKDVQLMRTREAFGPPAVGSDA

SEQ ID NO: 220 - protein, 202 aa, Gallus gallus
LLGLLLWAPLLWAPPPPVRGRRHGVYWNGSNPRFLQDDYSIQVSINDHLDIYCPHYSAPTPWAESFTLFMVDEEGYRGCSETPGAFKRWECNKPFAPFVPVRFSEKIQRFTPFSLGFEFRPGETYYYISVPTPGSAGRCLKLRVSVCCRASTPEPLTEVPNSQPRGRGGPEGDAGSPRDAAPIPQRSRTRLVALAVVAVLWV

SEQ ID NO: 221 - protein, 597 aa, Pan troglodytes
MLLLLLLLLLPPLLCGRVGAKEQKDYLLTMQKSVTVQEGLCVSVLCSFSYPQNGWTDSDPVHGYWFRAGDHVSRNVPVATNNPARAVQEETRDRFHLLGDPQNKDCTLSIRDTRESDAGTYVFRVERGNMKWNYKYDQLSVNVTASQDLLSRYRLEVPESVTVQEGLCVSVPCSVLYPHCNWTASSPVYGSWFKEGADIPCDIPVATNTPSGKVQEDTQGRFLLLGDPQTNNCSLSIRDARKGDSGKYYFQVERGSRKWNYIYDKLSVHVTALTHLPTFSIPGTLESGHPRNLTCSVPWACEQGTPPTITWMGASVSSLEPTISRSSMLSLIPKPQDHGTSLTCQVTLPGAGVTTTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAVGGAGATALVFLSFCIIFVVVRSCRKKSARPAVGVGDTGMEDTNAVRGSASQGPLIESPADDSPPHHAPPALATPFPEEGEIQYASLSFHKARPQYPQEQEAIGYEYSEINILK

SEQ ID NO: 222 - protein, 1364 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVDTLT

SEQ ID NO: 223 - protein, 2843 aa, Homo sapiens
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPGGCGSECHEGCVCDEGFALSGESCLPLASCGCVHQGTYHPPGQTFYPGPGCDSLCHCQEGGLVSCESSSCGPHEACQPSGGSLGCVAVGSSTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQQMCGLCGNYNGDPKDDFQKPNGSQAGNANEFGNSWEEVVPDSPCLPPTPCPPGSEDCIPSHKCPPELEKKYQKEEFCGLLSSPTGPLSSCHKLVDPQGPLKDCIFDLCLGGGNLSILCSNIHAYVSACQAAGGHVEPWRTETFCPMECPPNSHYELCADTCSLGCSALSAPPQCQDGCAEGCQCDSGFLYNGQACVPIQQCGCYHNGVYYEPEQTVLIDNCRQQCTCHAGKGMVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGSPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFNFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGQVEPWRNETFCPMECPQNSHYELCADTCSLGCSALSAPLQCPDGCAEGCQCDSGFLYNGQACVPIQQCGCYHNGAYYEPEQTVLIDNCRQQCTCHVGKVVVCQEHSCKPGQVCQPSGGILSCVNK

SEQ ID NO: 224 - protein, 905 aa, Gallus gallus
MDTFLLAWGFLGLCLPGSGGAAETAQPCGGRLNSKDAGYITSPGYPNDYPSHQNCEWVIYAPEPNQKIILNFNPHFEIEKHDCKYDFIEIRDGDSEAADLLGKHCGNIAPPTIISSGSSLYIKFTSDYARQGAGFSLRYEIYKTGSEDCSRNFTASNGTIESPGFPDKYPHNLDCVFTIIAKPKTEILLHFVLFDLEHDPLQAGEGDCKYDWLDIWDGIPQVGPLIGRYCGTKMPSDIRSTTGVLSLTFHTDLAVAKDGFSAQYYLIQQEVPENFQCNVPLGMESGRISNMQISASSTYSDGRWTPQQSRLNSDDNGWTPNVDSNKEYLQVDLHFLTVLTAIATQGAISRETQNGYYVRTYKLEVSTNGEDWMMYRHGKNHKMFQANEDATEVVLNKIHSPVLTRFVRIRPQSWHNGIALRLELYGCRITDSPCSNLLGMLSGLIPDSQISASSIRGYDWSPSMARLVSSRSGWFPRIPQAQPGEEWLQVDLGVPKNVKGVIIQGARGGDSVTTTESRSFVKKFKVAYSMNGKDWEFIQDPKTMQAKLFEGNIHYDIPEIRRFDPVPAQYVRVHPERWSPAGIGMRLEVLGCDWTDVKPTAETLVPTLKSEETTTPYPTDEEATECGDSCGEEEDFHLPANFNCNFDLPEDLCGWSHDSATGYTWSFQPASTWMGNSEPSPETLPDAKSYLRLQSSGRRESQRVRLISPTIYLPRSAVCMVFQYQVWGSSGVMLRVWREASQEHKALWVIAEDQGKEWREGRIILPSYDMEYRIVFEGFIRNGHAGELALDDIRLGNDIPLEYCMEPITAFPGATLLPGTEPTVDTVSVQPIPAYWYYVIAAGGAVVVLVSVALALVLHYHRFRYAAKKSDHSITYKTSHYANGAPVAVEPTLTIKLEQDPSSRC

SEQ ID NO: 225 - protein, 1066 aa, Xenopus tropicalis
ISAVNLLSYGKDAGDTEFVKRTVDFTSPLFQPQLGFPFGNKLHTNIYYTDNGQIIFPASQNDIFSYTNPPVGGFTSNYPVAMIAVFWDDADFSKNVGTTYFQEYTKNSVSAASNSTFQVVEDMVRRYVNASYTAQWILKITWENAPPYPAAAFSTQTNTYQAVLTTDGYISYVLMLYKDGAMNWNVSSRVANVVMGYSSGNGDNFYKNDDLMKRPPSERYRPCNYQGLTSANVRGLWIYNLNSQAVSNNRMTCMTWINSQPAPSTWNSGLVSCPCLYQQGISDSRFRKTKAGRKKYFTVSTTDLNNNAGVRCLYLNKKQFLEGFQERSWTSPSSQYAYDVCCNKLDDPQFCSLYIQKRPEINCRSYRSLSSGSSVGDPHMSTLDGLTYTFNGLDDFILLNATASVTSVILQGRTEQTGTARATNFQAFALQYTSDTSSVKVEWYLGTNDSITTYVNGQNVTFGYSEDMDTMINDSNPDVFLSMNTSVSATLGGSITVSVSAYYGILNAITNLPSEFFGQTRGLLGVWDSNMSNDFQMPNGTSISTNSSDEDIYNYGMLWKVTEGNLFTEPKTQRPNNGTFKPLFLKELKNSNGYGQLSATCQNNLECIYDALVTNNTDLALATRQAVVEFQATKAILNAIPPYISGNNTIQAFMKQTVTVQYTSNGTNITFAADLPYQDVNISSNGSLTWTPTSTEGFTLQLIATDSQNLSSVLKLMFVVCNCHLANECNYNQTTTVNATSLSIASCSCSDNYSGTFCQTAPNLCTQGCYTNVSCDPSAGCGKCPAGLTGDGLHCNGNGTVCTYDACESSYCFNGGTCRRQGTNWAQTCSCKSAFNGGRCETPKDNFPAQLITSNQCRGWQSGMAEEEQLERCMSLAAVFIMDWRGDSLWRGRPINRTLQQSRRDIIRDNASNGKNSLAQITAEFMYVADRTVFDYLNNNLVKKIQQTLHTTNSTSRAATQSIYNDVESGNYLTLDQMRQMLFCDAGEYSGAYTVDTNLTCVSNCVGYCQNDGQCTLLFNKTFCNCTSFTIYTVSGNQCEHLSMNLNAFFGILFGALAFLFLLMLG

SEQ ID NO: 226 - protein, 643 aa, Homo sapiens
MGLLPKLGVSQGSDTSTSRAGRCARSVFGNIKVFVLCQGLLQLCQLLYSAYFKSSLTTIEKRFGLSSSSSGLISSLNEISNAILIIFVSYFGSRVHRPRLIGIGGLFLAAGAFILTLPHFLSEPYQYTLASTGNNSRLQAELCQKHWQDLPPSKCHSTTQNPQKETSSMWGLMVVAQLLAGIGTVPIQPFGISYVDDFSEPSNSPLYISILFAISVFGPAFGYLLGSIMLQIFVDYGRVNTAAVNLVPGDPRWIGAWWLGLLISSALLVLTSFPFFFFPRAMPIGAKRAPATADEARKLEEAKSRGSLVDFIKRFPCIFLRLLMNSLFVLVVLAQCTFSSVIAGLSTFLNKFLEKQYGTSAAYANFLIGAVNLPAAALGMLFGGILMKRFVFSLQTIPRIATTIITISMILCVPLFFMGCSTPTVAEVYPPSTSSSIHPQSPACRRDCSCPDSIFHPVCGDNGIEYLSPCHAGCSNINMSSATSKQLIYLNCSCVTGGSASAKTGSCPVPCAHFLLPAIFLISFVSLIACISHNPLYMMVLRVVNQEEKSFAIGVQFLLMRLLAWLPSPALYGLTIDHSCIRWNSLCLGRRGACAYYDNDALRDRYLGLQMGYKALGMLLLCFISWRVKKNKEYNVQKAAGLI

SEQ ID NO: 227 - protein, 263 aa, Gallus gallus
MACLERCHCCADGRRHGSILYSILKSHDQAAEGPGPRRGQAGRGCSCGSQRRVALKSPQVVCKAASAVLVKTLRFVQNVPCFQELPLDEQLVLVRSCWAPLLVLGLAQERVHLETVESAEPSMLQRILTTRRLGEHAPAPGRQHPPSAGEIQAIKGFLAKCWSLDISTKEYAYLKGTVLFNPDLPGLQCTQYIEGLQKEAQEALNEHVRLIHRGDQARFAKLNVVLSLLRSINANVIAELFFRPIIGSVNMDDMLLEMLCAKL

SEQ ID NO: 228 - protein, 244 aa, Xenopus tropicalis
MVLDSTGPLGQPLRQLEDMAELCLLTPLSALSAGTFIQCSVQTPANLVEQVLLGYVEQIALIIIKVFTSCEPRKAKLCPDQIAAEKESSRNFNSFFFFFSLKPSVMCILLRKNKCASVFQSRNAKLKMHKMSYIHLLYLALCFLTLTHSAAAGPETLCGAELVDTLQFVCGDRGFYFSKPTGYGSSNRRSHHRGIVDECCFQSCDFRRLEMYCAPAKPAKSARSVRAQRHTDMPKAQKHVIFGL

SEQ ID NO: 229 - protein, 411 aa, Xenopus tropicalis
MPSVMVHLSKEEPYVMFKRSDTPLFGKDRFEGFCIDLLKKIAEILGFDYDIRLVEDAKYGSQDEKGQWNGLVKELIDHHQLAGCLFFCAAAASVPLLFLTASVLCLAASVLCRCHGNLMLGGVRMRRLRSQVAKSGKERGIMGIFSTLLSIFSKCLASDLLKWRNMGRLKGTIETTEGLWHMGRLVARDKSPVSQATPQVAITCHPTSESGPCSPTSEKKADLAVAPLTITHVREKVIDFSKPFMTLGISILYRKANGTAPSVFSFLNPLSPDIWMYILLAYLGVSCVLFVIARFSPYEWYDAHPCNPGTDVVENNFTLLNSFWFAVGALMQQGSELMPKALSTRIIGGIWWFFTLIIISSYTANLAAFLTVERMESAIDSADDLAKQTKIEYGAVVDGATMNFFKINVVY

SEQ ID NO: 230 - protein, 2551 aa, Homo sapiens
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 231 - protein, 319 aa, Gallus gallus
MSRYKDDSLVPPFLLDCSLVPLHSVSTNGPILTSLEYQGACSLNLIQLGSQSQRRVTFHLPDGSQESCSDSGLGDHEPVGGGTLISHPLPLVQPQDEFYDQASPDKRTEADGNSDPNSEGRNTVFCINWISLAQAFKCDKWRCAKLPESNSGCQRTTVAASLQTISSLLRDRYCSGQPLTLVVLQQLARDVAYAFNGPLGPRGLAEATEMCTQECLVLGHSDNCWMPPSLGPYQQPKSPLSTFAPQKEWVKKDKLVNGHTLTRTWKEDSNRNQFSDRKQYGSSEGHFNTGNHMTDIPLANLKSYKQASGAAESPKEHQL

SEQ ID NO: 232 - protein, 2188 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 233 - protein, 1622 aa, Canis familiaris
MTKRQISVCQQTWALFCKNLLKKWRMRRESFMEWFNPLLLLLCLYLFPTNHKVNDFSSLPDMDLGPVDSFKDSLFSIVYTPITNTTQQIMDKVALASFMKDKKVLGLSNEESIKEVMTHYPEEIIQVIFTNTFSYHLKFTLGHRIPTRREHRDHEAHCYNLSEGVKCQVSKYWKQGFVALQAAINAAIIETTTNHSVMEELMSVTGKNMKIHPFIRQGGIVADFFIFFCIISFSSFTYYASINVTRERKKMKVLMKMMGLRDSAFWLSWGLLYAVFIFIMALFLALIIKSVQFVILTGFMAIFTLFFLYGLSLIALAFLMSVLVKKSFLTGLIVFLLTIFWGSLGFTALYRHLPTSLEWILSFLSPFAFSLGMAQLLHLDYDLNSNAFPYPSDDSKLIIATNFMLAFDLFFYVALTIYFEKILPNEHGHEYPPLFFLKPSFWSRQHKADHVALEDEIDSNPSSNDSFEPMPPEFHGKEAIRIRNVTKEYKGKPDKIEALKDLVFDIYEGQITAILGHSGAGKSTLLNILSGLSVPTKGSVTIYNNKLSEITDLENISQLTGICPQSNVQFDFLTVKENLRLFAKIKGIRPHELDKEIQRILLELEMKNIQDVLAQNLSGGQKRKLSFATAILGDPQVFLLDEPTAGLDPFSRHQVWNLLRERKADRVILFSTQFMDEADILADRKVFLSSGKLKCAGSSLFLKKKWGIGYHLSLQLNEMHVQENITSLIKQHIPDAKLSAESEGKLVYTLPLERTNRFPALYEDLDRCPSLGIENYGVSMTTLNEVFLKLEGKPAIDESDFAMLGEAQAERTGDTERLVETEQVLSSLNEMRTTLGGMALWRQQICTIARVRFLKLKHERKVFLSLFLILGIGICPLLLENIIMRIYERSYTWDLSPHLYFLAPGQQPRDPLTQLLIINKTGASIDDFIHSVEHQNIALEVDVFGTKNGLDDPSYNGAITVSGNTKNYSFSLACNTKRLNCFPVLMDIISNALLGMITPSAHIQTDRSTFSSERQSNPFEFPGYTTFWLILASSCAPYIAMGSIDDYKNKIQSQLRISGLFPSAYWFGQALVDVPMYCLIFLLMYLMDYGLNLQETFFKITSPIIQIPCAVGYSTSLIFLTYVISFIFRKGKRNSGIWSFGFCMITAFSVFILLFDYHEHVALYCLIFLVPQTTLIGCMVFYFIQAMAYYTTQEPRSVGPFLVFLIPFLHFIIFLFTLRCLEWKYGKKSMRRDPFFRISPRSNDVCQNPEALEGEDEDVQMERVRTADALNSTNSDEKPVIIASCLRKEYSGKRKYCSSKRKKKIATRNVSFCVRKGEVLGLLGHNGAGKSTSIQVITGDTKPTAGQVLLKGSSGDGSLGFLGYCPQENVLWPNLTVKEHLEVFAAVKGLKKADAAVTISRLADALKLQDQLKLPVKTLSEGIKRKLCFALSILGNPSVVLLDEPSTGMDPEGQQQMWQAIRATFKNTERGALLTTHYMAEAEAVCDRVAIMVSGKLRCIGSIQHLKSKFGKNYYLEMKVKTPEQRESLHQEILRAFPQAAQQKRYSPVMVYKLPMEDVRPLAQAFFTLERVKQSFDLEEYSLSQSTLEQVFLELSKEQELDDFDEEPDLSVKWKLLPQEDP

SEQ ID NO: 234 - protein, 1894 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKGRLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 235 - protein, 1305 aa, Gallus gallus
MDSPALGAVALLLAGFWHLGLTATNYNCDGALVSTLPSSAFTSSSEFFSTHSPSFAKLNRRDGAGGWSPLDSNEQQWLQVDLGDRVEIVGVATQGRYGSSDWVTSYTLMFSDTGRNWKQYRKDDTVWVFTGNSNADSVVHHKLLHSMKARFLRFVPLKWNVGGHIGLRVEVFGCSYKSDIADFDGRSSLLYRFNQKLMSTFKDVVSLKFKSMQEDGVLFHGEGQRGDYITLELQKGKLSLHINLGDSNLHFTNSHTSVTLGSLLDDQHWHSVLIERFNKQVNFTVDKHTQHFRTKGDSDHLDIDYELSFGGIPVPGKPGTFQRKNFHGCIENLYYNGVNIIDLAKRRKPQIYTGNVTFSCSEPQIVPITFVSSSRSYLLLPGTPQIDGLSVSFQFRTWNKDGLLLSTELSENSGSLLVYLHGGRLTLLIQKVAEDPVEISEGTNLHDGLWHSLNINARRHRITLTLDNNAATASHATTVSRIYSGNSYYFGGCPDNFTDSQCLNPITAFQGCMRLIFIDNQPKDLILVQQGSLGNFSDLHIDLCDIKDRCLPNYCEHGGKCSQSWTTFYCDCNDTSYMGATCHNSIYEQSCEAYRHQGKTSDFFYIDSDGSGPLGPLRVFCNITEDKIWTAVQHNNTGLTRVQGAGPEKPYTMSFNYNSSAEQLEAVINSAEYCEQEAAYHCKKSRLLNTPNGIPFAWWVGRANEKHLYWGGSLPGIQQCACGLEESCLDMRYFCNCDADREEWTNDTGLLAFKDHLPVTQIVITDTNRSNSEAAWKIGPLHCYGDRQFWNAASFNTEASYLHFPTFHAEVSADISFFFKTTSLSGVFLENLGMKDFIRVEIRSPKEITFSIDVGNGPTEATVQSPTPLNDNQWHYVRAERNLKQTSLQVDNLPKKVLEAPAEGHFRLQLNSQLFVGGTASRQKGFLGCIRSLHLNGQKLDLEERAKMTPGVKPGCPGHCSSYGNLCHNGGKCVEKYNGYSCDCTSSAYEGPFCKEEVSALFEAGTSITYIFQEPYPVTKNASTSSSAIYADAITSKENIAFSFLTAHAPSLLLYINTYFHEYLAVILSKNGSLQVRYKLSKDGLLIFTIDSGNFANREMHHVKINREGRELIIQVDQVIKLKHNFSEIDFKAIKSLTLGKVTDSLPLDPEVSKANAYGFTGCMSSVWYNHVAPLKAALRHPSIAPVTVKGSLTESSCSSLMETDVNTATTIYSSSDPFGKTDEREPLTNAVRSDSAVIGGVIAVVIFIIFCIIAIMSRFLYQHKQAHRSSQTKEKEYPENLESSFKADIDLQNTVSECKREYFI

SEQ ID NO: 236 - protein, 838 aa, Rattus norvegicus
MSSAVLVTLLPDPSSSFREDAPRPPVPGEEGETPPCQPSVGKVQSTKPMPVSSNARRNEDGLGEPEGRASPDSPLTRWTKSLHSLLGDQDGAYLFRTFLEREKCVDTLDFWFACNGFRQMNLKDTKTLRVAKAIYKRYIENNSVVSKQLKPATKTYIRDGIKKQQIGSVMFDQAQTEIQAVMEENAYQVFLTSDIYLEYVRSGGENTAYMSNGGLGSLKVLCGYLPTLNEEEEWTCADLKCKLSPTVVGLSSKTLRATASVRSTETAENGFRSFKRSEPVNPYHVGSGYVFAPATSANDSELSSDALTDDSMSMTDSSVDGIPPYRMGSKKQLQREMHRSVKANGQVSLPHFPRTHRLPKEMTPVEPAAFAAELISRLEKLKLELESRHSLEERLQQIREDEEKEGSEQALSSRDGAPVQHPLALLPSGSYEEDPQTILDDHLSRVLKTPGCQSPGVGRYSPRSRSPDHHHHHHQQCHALLPTGGKLPPEAACPLLGGKSFLTKQTTKHVHHHYIHHHAVPKTKEEIEAEATQRVRCLCPGGTDYYCYSKCKSHSKPPEPLPGEQFCGSRGGTLPKRNTKGTEPGLALPAREGGMSSAAGAPQLPGEEGDRSQDVWQWMLESERQSKSKPHSTQSIRKSYPLESARAPPGERVSRHHLLGASGHPRSAARAHPFTQDPAMPPLTPPNTLAQLEEACRRLAEVSKPQKQRCCVASQQRDRNHPATGQAGPTSFSNPSLASEDHKEPKRLASVHALQASELIVTYFFCGEEIPYRRMLKAQSLTLGHFKEQLSKKGNYRYYFKKASDEFACGAVFEEIWDDETVLPMYEGRILGKVERID

SEQ ID NO: 237 - protein, 2849 aa, Homo sapiens
MAEEAAQNISDDQERCLQAACCLSFGGELSVSTDKSWGLHLCSCSPPGGGLWVEVYANHVLLMSDGKCGCPWCALNGKAEDRESQSPSSSASRQKNIWKTTSEAALSVVNEKTQAVVNEKTQAPLDCDNSADRIPHKPFIIIARAWSSGGPRFHHRRLCATGTADSTFSALLQLQGTTSAAAPCSLKMEASCCVLRLLCCAEDVATGLLPGTVTMETPTKVARPTQTSSQRVPLWPISHFPTSPRSSHGLPPGIPRTPSFTASQSGSEILYPPTQHPPVAILARNSDNFMNPVLNCSLEVEARAPPNLGFRVHMASGEALCLMMDFGDSSGVEMRLHNMSEAMAVTAYHQYSKGIFFHLLHFQLDMSTYKEAETQNTTLNVYLCQSENSCLEDSDPSNLGYELISAFVTKGVYMLKAVIYNEFHGTEVELGPYYVEIGHEAVSAFMNSSSVHEDEVLVFADSQVNQKSTVVIHHFPSIPSYNVSFISQTQVGDSQAWHSMTVWYKMQSVSVYTNGTVFATDTDITFTAVTKETIPLEFEWYFGEDPPVRTTSRSIKKRLSIPQWYRVMVKASNRMSSVVSEPHVIRVQKKIVANRLTSPSSALVNASVAFECWINFGTDVAYLWDFGDGTVSLGSSSSSHVYSREGEFTVEVLAFNNVSASTLRQQLFIVCEPCQPPLVKNMGPGKVQIWRSQPVRLGVTFEAAVFCDISQGLSYTWNLMDSEGLPVSLPAAVDTHRQTLILPSHTLEYGNYTALAKVQIEGSVVYSNYCVGLEVRAQAPVSVISEGTHLFFSRTTSSPIVLRGTQSFDPDDPGATLRYHWECATAGSPAHPCFDSSTAHQLDAAAPTVSFEAQWLSDSYDQFLVMLRVSSGGRNSSETRVFLSPYPDSAFRFVHISWVSFKDTFVNWNDELSLQAMCEDCSEIPNLSYSWDLFLVNATEKNRIEVPFCRVVGLLGSLGLGAISESSQLNLLPTEPGTADPDATTTPFSREPSPVTLGQPATSAPRGTPTEPMTGVYWIPPAGDSAVLGEAPEEGSLDLEPGPQSKGSLMTGRSERSQPTHSPDPHLSDFEAYYSDIQEAIPSGGRQPAKDTSFPGSGPSLSAEESPGDGDNLVDPSLSAGRAEPVLMIDWPKALLGRAVFQGYSSSGITEQTVTIKPYSLSSGETYVLQVSVASKHGLLGKAQLYLTVNPAPRDMACQVQPHHGLEAHTVFSVFCMSGKPDFHYEFSYQIGNTSKHTLYHGRDTQYYFVLPAGEHLDNYKVMVSTEITDGKGSKVQPCTVVVTVLPRYHGNDCLGEDLYNSSLKNLSTLQLMGSYTEIRNYITVITRILSRLSKEDKTASCNQWSRIQDALISSVCRLAFVDQEEMIGSVLMLRDLVSFSNKLGFMSAVLILKYTRALLAQGQFSGPFVIDKGVRLELIGLISRVWEVSEQENSKEEVYRHEEGITVISDLLLGCLSLNHVSTGQMEFRTLLHYNLQSSVQSLGSVQVHLPGDLAGHSPAGAETQSPCYISQLILFKKNPYPGSQAPGQIGGVVGLNLYTCSSRRPINRQWLRKPVMVEFGEEDGLDNRRNKTTFVLLRDKVNLHQFTELSENPQESLQIEIEFSKPVTRAFPVMLLVRFSEKPTPSDFLVKQIYFWDESIVQIYIPAASQKDASVGYLSLLDADYDRKPPNRYLAKAVNYTVHFQWIRCLFWDKREWKSERFSPQPGTSPEKVNCSYHRLAAFALLRRKLKASFEVSDISKLQSHPENLLPSIFIMGSVILYGFLVAKSRQVDHHEKKKAGYIFLQEASLPGHQLYAVVIDTGFRAPARLTSKVYIVLCGDNGLSETKELSCPEKPLFERNSRHTFILSAPAQLGLLRKIRLWHDSRGPSPGWFISHVMVKELHTGQGWFFPAQCWLSAGRHDGRVERELTCLQGGLGFRKLFYCKFTEYLEDFHVWLSVYSRPSSSRYLHTPRLTVSFSLLCVYACLTALVAAGGQEQPHLDVSPTLGSFRVGLLCTLLASPGAQLLSLLFRLSKEAPGSARVEPHSPLRGGAQTEAPHGPNSWGRIPDAQEPRKQPASAILSGSGRAQRKAASDNGTACPAPKLQVHGADHSRTSLMGKSHCCPPHTQAPSSGLEGLMPQWSRALQPWWSSAVWAICGTASLACSLGTGFLAYRFGQEQCVQWLHLLSLSVVCCIFITQPLMVCLMALGFAWKRRADNHFFTESLCEATRDLDSELAERSWTRLPFSSSCSIPDCAGEVEKVLAARQQARHLRWAHPPSKAQLRGTRQRMRRESRTRAALRDISMDILMLLLLLCVIYGRFSQDEYSLNQAIRKEFTRNARNCLGGLRNIADWWDWSLTTLLDGLYPGGTPSARVPGAQPGALGGKCYLIGSSVIRQLKVFPRHLCKPPRPFSALIEDSIPTCSPEVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLELSVVGVSLTYYAVSGHLVTLAGDVTNQFHRGLCRAFMDLTLMASWNQRARWLRGILLFLFTLKCVYLPGIQNTMASCSSMMRHSLPSIFVAGLVGALMLAALSHLHRFLLSMWVLPPGTFTDAFPGLLFHFPRRSQKDCLLGLSKSDQRAMACYFGILLIVSATLCFGMLRGFLMTLPQKRKSFQSKSFVRLKDVTAYMWEKVLTFLRLETPKLEEAEMVENHNYYLDEFANLLDELLMKINGLSDSLQLPLLEKTSNNTGEARTEESPLVDISSYQAAEPADIKDF

SEQ ID NO: 238 - protein, 1238 aa, Xenopus laevis
MVPVLFVAACCSWWMFREGVSAVQQVFRVQPDNITIVKGSTALLSCEVEHGTGMVQWEKNGLLLGPDRNIPGFPRYSMTGDPHKGEYNLRIERIELDDDAEYHCQVGRSEVSLGIISLTALINVLIPPKAPTFEEHAVGSRVTWVYGVEYTVTCQATDAKPAAVLTIKKSDLEVSGDSSTSPGSRDRLENTALVTKVIPQSSDNGKLLTCLALNPALQTPITVSFTMNVLFPPNAPIIEGYTGPSVKAGETLKLICISLSGNPLATLQWSKNDDVVSTRWETDEVVRSSRSHLTLSIKPADNMAVVSCEAVNHVTPQTLKTSIILNVVFLPTEVTILGSPSGPEKSSLSFSCFTAASNPPVQIRWWLGPKELVNTIVTITDAAHGGKVTMSNLTMVALREEHGMSLTCEAFNEVILYTKSNSVTLSVQYPPQNVWIEAPPTDKFFRAGTAVKMTCFSSGGNPPPRLTWIKDTKSLSGGTQIHSGKIVTKEITIITVPSDNLATYRCNASNIGKTALTASTKLKVQFPAIDVNIMSSAKEYRRGSTITLTCVTGSSNPASTISWVKNGEQLKAQDLGRKPSLYGGISSSSRVTLIATSKDNGRRVSCEAFSSVLNEAVNTFYKLNILFPPEFLDDQPTVVQAVEHGAALIPVRVRANPPQINYTWSLWGEKLIRDGAYRHHLRGEGALEIWNVSRADSGIYNVTCVNKEGKNSVVIRLDVQYSPTIRSLGDTEVDLGADAEIVCTADANPVTDSMFQWRWLGDEERDLSALERRVDGVTGRLVIREAKRTDAGRYECAVDNGIPPSVKADARLIVRFKPDIHKGVHLSKVAVPGDGKSVAALVCKAEGIPSVAFSWAKNGVSLDLKGPRYSEKTFHELSVHTSTLVISNVSAVKDYALFTCTAMNTLGVDSFSIQLVSTSRPDPPSGLKVIGFTHNSVTLQWSSGFDGGAEQKFRVRYRWPETDSHMYVDVFPPQDTVFTITGLKGSTAYNFSVNAINALGESDYADQGAVVSVTTKETTLLLVPTQQPTRVPVAESLEWPPYILAAVCAGGALLLISNAAFIGCLVKRSRDKSQGGEGEKKDESGQERTLNEYGDGELINTHAKKTLLIDSGSETGSSLYQDSTSESGIYYYPVRDYRPSLFPHYEVPERGEPGIQGWEEGGYEDWYATSEGHEYAEVGEDYPQSSRVRWHNREMANQGRETSWAEYQDPGRLRIYDEADAPLSDIYETPYGGRGQLV

SEQ ID NO: 239 - protein, 389 aa, Homo sapiens [sequence omitted]

SEQ ID NO: 240 - protein, 325 aa, Gallus gallus
DGMKSHTEEHYVPLLVSTRSAKESSVSANSGREATAITAGDPACFSFSSAVSHLACRVGEPRHSQPARRRDALCSRTAVLGRRSRPLSDVMTVLKLSLMAFSFVFWAAGLTMLIVGLWAKVRLGGYLALSASDSPSAPAILLATGTAVIVWAFLGCFSAATEHRGLLRTYGVFLAAVLLAGLTAGLSALLYRQDIARGFREGLRQALSAYGEDEGKADALDALQRTLGCCGVESYRDWLASPWALQQNASVPLSCCRARRGCSLSSAGARGLHPEGCFGKVSALVSSNMFCIATAALGLAVLQVVGIVLACLMAARVPAHITALH

SEQ ID NO: 241 - protein, 401 aa, Xenopus tropicalis
MAFLSLFLCLVFSSPLMAMPPALQGRKAISPASILKGPSTDNGARDFHGRKFPHFMMQLYQNIISRRDKDLSNLEHPTLQESDTVQSFIAKSYTTVGNHWTLFFDMSSISTNNELKLAELRICLPSFGKSHSVTVEIYHTKDTKEKLFMGSFKTKISSALDADCKVFNLTMVLHNYLIRGKRLIKDEYIQAKGLLLRDLEKSAAEKGAENVDTLKQDKHHVSDFAAERIILVVFAKERSQAKPDPPSLGKQLFPLKYGMADNANKVNGFRRLRRNKKEKTRMDVGTTPPKPVEEIKPKCRKVDMFVDFQKIGWGSWIVYPKAYNAYRCESACAVPLNETDDATNYSYIKSLLPLSDTERRECPSCVPVKMRSMSMLYYENEEFILRHHEEMIVEECGFKDI

SEQ ID NO: 242 - protein, 1044 aa, Homo sapiens
MGVALRKLTQWTAAGHGTGILEITPLNEAILKEIIVFVESFIYKHPQEAKFVFVEPLEWNTSLAPSAFESGYVVSETTVKSEEVDKNGQPLLFLSVPQIKIRSFGQLSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKLLLDMVGSPDQDLQEAAAGCISNIRRLALATEKARYT

SEQ ID NO: 243 - protein, 1339 aa, Rattus norvegicus
MAHSERANGLQESNQRYGSLQEQLPKAGNQAVGPIEIFRFADNLDIVLMTLGILASMINGATVPLMSLVLGEISDHFINGCLVQTNKTKYQNCSQSQEKLNEDIIMLTLYYVGIGAAALVLGYVQISFWVITAARQTTRIRKQFFHSILAQDISWFDGTDICELNTRMNGDISKLCDGIGDKIPLMFQNISGFSIGLVISLIKSWKLSLAILSTSPLIMAASALCSRMVISLTSKELDAYSKAGAVAEEALSSIRTVTAFGAQEKEIQRYTQNLKDAKDAGIKRAIASKLSLGAVYFFMNGAYGLAFWYGTSLIFGGEPGYTVGTILAVFFSVIHSSYCIGSVAPHLETFTIARGAAFNIFHVIDKKPNIDNFSTAGYKPESIEGNIEFKNVSFSYPSRPSAKILKGFNLKIKSGETVALVGPSGSGKTTTVQLLQRLYDPEEGCITVDENDIRTQNVRHYREQIGVVSQEPVLFGTTIGNNIKFGREGVSEEEMEQAAREANAYDFIMAFPKKFNTLVGEKGAQMSGGQKQRIAIARALVRNPKILILDEATSALDTESESLVQAALEKASKGRTTLVVAHRLSTIRGADLIVTMKDGEVVEKGIHAELMAKQGLYYSLAVAQDIKKVDEQMESRTCSAAGNASNGSLCNVNSAKSPCTDQFEEAVPHQKTTLPEVSLLKIFKLSKSEWPFVVLGTLASALNGSVHPAFSIIFGKLVTMFEDKNKTTLKQDAELYSMMLVVLGIVALVTYLMQGLFYGRAEEILAMRLRHSAFKAMLYQDMAWYDEKDNSTGALTTTLAVDVAQIRGAATSRLGIITQDVTNMSLSILISFVYGWEMTLLILSFAPILAVTGMIQTAAMAGFANKDKQELKRAGKIATEAVENIRTVVSLTREKAFEHMYEETLRTQHRNALKRAHITGSCYAVSHAFVHFAHAAGFRFGAYLIQAGRMTPEGMFIVFTAIAYGAMAIGETLVWAPEYSKAKAGAAHLFALLKNKPSIDSCSQNGEKPDACEGNLEFREVSFFYPCRPEVPVLQDMSLSIEKGKTVAFVGSSGCGKSTCVQLLQRFYDPMKGQVLLDGVDVKELNVQWLRSQTAIVSQEPVLFNCSIAENIAYGDNSRMVPLEEIKEVADAANIHSFIEGLPGKYSTQVGLRGMHLSGGQKQRLAIARALLRKPKILLLDEATSALDNESEKMVQQALDKARRGRTCLVVAHRLSTIQNADMIVVLQNGRIKEQGTHQELLRNGETYFKLATAHYGAAETLKDDDDDDDDDDDDDDDKRDSRLCSAVARHRVALAVRVEGAGGRLAFVCAGSPEGPSTSTSDTPGFHCYPGAAGAGAA

SEQ ID NO: 244 - protein, 974 aa, Xenopus laevis
MLPAVFVILALSAVQGLEETLMDTKWTTSELAWVAYPDSGWEEVSGYDEASNPIRTYQVCNVRDSNQNNWLRTQFIPRQDVQRVYVELKFTVRDCNSLPNLRGSCKETFNFFYYESDSDSASADSPFWMENPYIKVDTIAPDESFSRRDSGRVNTKIRSFGPISRAGFYLAFQDLGACVSLISVRVFFKKCPRTTAGFASFPETITGAEPTSLVIAPGTCVPNALEVSVPLKLYCNGDGDWMVPVGACTCAAGFEPAGKDTQCQACKRGTYKSKQGEGSCMPCPANSRAISSAATICSCQNGYYRADGESAETACTSVPSAPRQVISNVNETSVVLEWAEPGHLGGRDDVLYNVICKKCLERLCSRCDDNVQFWPRQLGVTQRLVSVSHLQAHTKYSFEIQAVNGVSGKSPHIPNYFTVNITTNQAAPSSVPMVQSHGSLANSLTLSWAPPESPNGIILDYEIKYYAKGHIGAGNTVTSQRTTVRMEGMTPDTVYVVQVRARTVAGYGAYSEPREFQTIAEDGDRSSLQEQVPMVVGSVTAGLIFIIAVVIIVIVCFSRKQRNDSESEYTEKLQQYMVPGMKLYIDPFTYEDPNEAVRDFAKEIDISCVKIEEVIGAGEFGEVCRGKLKQAGRREQFVAIKTLKAGYTEQQRRDFLGEASIMGQFDHPNIIRLEGVVTRSRPVMILTEFMENGALDSFLRMNDGQFTVIQLVGILRGIASGMKYLSEMNYVHRDLAARNILVNSNLVCKVSDFGLSRFLENSRSDPTYTSALGGKIPIRWTAPEAISYRKFTSASDVWSYGIVMWEVMSYGERPYWDMSNQDVINAIEQDYRLPPPMDCPSALHQLMLDCWLRDRNLRPKFSQIVSSLDKLIRNAASLKVTSPGQAGVSQQLLDRTVPDYTTFPTVSDWLEAIKMGQYQENFLSAGFTSFHLVAQMTAEDLLRIGVTLAGHQKKLLNSVQDMRLQMSQTLPVQV

SEQ ID NO: 245 - protein, 989 aa, Mus musculus
MRTTLWPLSLGSLLTLGAALTGTSSEGDQGNLRLAHRQSTCDGVVLVRHQGEWGHLCNLEWTLAEASVVCRQLGCGPAVGAPKYVPLPGEMVRPWLHNVSCWGNESSLWECSLGAWSQRACPHEWVVVALCANGTFREIRLVKGHSPCAGLPEIMNVNGVDRLCGLHVEEATVFCRELQCGHALQAPRQDVGVSKYMTCKGTESTIRNCRLNNKLRGGCNLLLDAEVICSGHVEARLVGGEHSCAGRLEVLRGLTWGTICHADLDLPTAHVVCRELGCGIAVSTLGGAQFGQGSGPVWLEAFRCVGNESLLFHCPREPGHHCGHEQDAALTCSEFRLVNGSSDCEGRVELQVQGTWAPVCAANWDLADAMVLCHQLNCGNAVSVPPGGHFGDGDDLIWPDIFHCVGTEPHLLHCAASTLGAHGCVLGNTASTICSGLQDILRLRDGQSYCDGRVEISLDGSWGRVLDDAWDLHGASVVCRQLGCGEAQRAYDAPAPIFRRVPVGLSQVRCLGSETRLVHCNVSTSLLVPAGTLRDAGVVCSGSLRVRLAAGPGRCAGRVELFYQGSWGTVCDDAWDLQDAQVVCRQLDCGHALSAPRNAHFGAGTGHIWMDELHCLGNESSLWKCQSGSWGQHDCRHKEDAGVFCSESVALRLRGGTSGCVGWLDVLYNGSWGAVCSNALRDISLSIICRQLGCGDQGWLENRPSSGAGLGISWVDNIKCRNLHNATLWQCPSAPWNPHSCTQEEEVWINCEGTPQIALQDPAQTPNCSSPFGCLENSVLRVLGGEDGCSGRVELWHAGSWGTVCDDSWDLVDAEVVCRQLGCGQALAALGEASFGPGVGPVWLDEVECLGSEVTLEACQAEPWGHGDCTHKEDAGVRCAGVSTTTALSPSLTPPSVAEVWKLSEIACLVLGCLLGIVFLVMIAQWCHIRDASMGAGMLGHLQSEGIYEDIEVDPVPKKEENTVSRLLMLEEGYDDAEEPEDQPTENDE

SEQ ID NO: 246 - protein, 389 aa, Homo sapiens
MHACSSTALHPRPFIHGFSFTTFLQQLFPHGSSTALHPWPFIHGSSPMALHPRLFTHGPSSTALHPCPFTHGSSPMSLHPRLFTHSPSSMPLHPRPFVHASSPTALRPCLFTHGPSSMPLHPRPFVHASSPTALPPCLFTHGPSSMPLHPRPFLHASSPTALPPCLFTHGPSSMPLHPRPFVHASSPTALRPCLFTHGPSSMPLHPRPFVHASSPTALPPCLFTHGPSSMPLHPRPFVHASSPTALRPCLFTHGPSSMPLHPRPFLHASSPTALRPCLFTHGPSSMPLHPRPFVHASSPTALRPCLFTHGPSSMPLHPRPFVHASSSTSLHPRPFIHASSSKSLHLRLFSHSSCLVGFSQQGNVLLLSARATFNTCLLVSNMYFLIISY

SEQ ID NO: 247 - protein, 1479 aa, Macaca mulatta
MGPGRPASAPWSRHLLRCVLLLGGLHFGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFRWLSGDEVMYTHWNRDQPGYSRGGCVALATGSAMGLWEVKNCTSFRARYICRQSLGTPVTPELPGPDPTPSLTGSCPQGWASDPKLRYCYKVFSSERLQDKKSWVQAQGACQELGAQLLSLASYEEEHFVANMLNKIFGESEPEIHEQHWFWIGLNRRDPRGGQSWRWSDGLGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELEFLGHNLQKFSRAQEQHWWIGLHTSETDGRFRWTDGSIINFISWAPGKPRPVGKDKKCVYMTASREDWGDQRCLTALPYICKRSNVTKETQPPDLPTTALGGCPSGWIQFLNKCFQVQGQDPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESRNASLAYVPDPYTQAFLTQAARGLRTPLWIGLAGEEGSRRYSWVSEEPLNYVGWQDGEPQQPGGCTYVDVDGAWHTTSCDTKLQGAVCGVSSGPPPPRRISYHGSCPQGLADSAWIPFREHCYSFHMELLLGHKEALQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNVTMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 248 - protein, 1115 aa, Homo sapiens [sequence omitted]

SEQ ID NO: 249 - protein, 1591 aa, Gallus gallus
MAGGARLWLCAAVLGCLAAAKPRRRVLECHPGGHQILQSPYRSVDFDSSHLQQSAIQDLICDHSLAPGWYRFMIFDKPAEMPTKCVEMNHCGTQAPVWLSLKESESMPRPGEIKQLTACATWKFFFSTYKDCCLFQIPVSVRNCGDFFVYLLQPTQGCMGYCAEGEKVYCSSSAFFMEKPSIQSSAVESKEFLAGIKIHPEAFDISEDGKEYRLSIESRIPIPCPEFNQVESDCRISLRLNTVDEGKEQLGLNLALSSCHVDLLQKPCRNGICSQAIIYFTAVTDFMQDGDRITRIAVEPISSENFLWNGYVPESTKITVKDLPTAYCYSFTDPHIITFDGRLYDNFKTGTFVLYKSTARDFEVHVRQWDCGSLQYPASCNCGFVAKEGSDIIAYDMCSGQLHESQPHLSIISRDTTGSNVRITESYLGRKVTVLFSSGAFIRADVSEWGMSITLRAPSSDYRNTMGLCGTFDGNAENDYHTANGVEIPNNSDALFSFIKEWRIPPGGSLFDNTPASLPSSRKTDFCDCTFEDAGLDPSVHKLKAISKSELPLSCKDSENGRYLSLIPGLEVTAEYLSPADLVKGLNKRSSVHEMDSSTLLRKGDNQTKLHKSSSVNRHVSEISEISFGIEKEGTSDIKRISDSYSNLHKSQSVTSRRKRQSYYEYHPVFLFQSLSQRDLEGYRYFFPEDHTTGEDKKFLPSWPTPSGLTESSALRLCQQAIANSSIGRACGGLLGRRMQDAINICVKDLLLKDDLRWAEASLALLENECEKRVLEEINYNQQELQGFVENMLIALKCPSLCSGNGECTEWGCACFQGYGSYDCSILSDQAPEITELENAGLCDIRQYDCTSVRAFGHGFRESSNLKCEIIRLQYTDSQWIPGEPLITSAAFQNVRTVDCELPNNGPQPDVVDLVDDKPIAWWKIKISNDGLTYSNAKTMIIYDGACQICELQESGLCALKSSTYTKHEVNTRNWIKRQVVLINHLIFGHNQPPVLETFQGMLQTFYGEDFVYQFLASDPEGSAILFTLESGPEGASLSPSGLLLWKAVSKNPRKLTFSLTDDCNAETKVEIEVRVNSCDCLNNGSCVTNINFPPGSGRYLCVCVAGFEGDLCQVNTDDCKLNRCGTGKCVDGVNSYYCECPPELQETFEDIYAERKDSTEAGENKGFEQSSFDNVLSSVPSSTDVPQRFISIEMDNTSTLSASRPKTVTTEKSDSTQRSASVQSDVTENIAHALGSTSGHLTGTEGASPENTVMTASSRSHAVSAEKKTRAKVEAYSHWETNRKASLSSSANTSKGLSLPHNVFKGRNAHRVQHLLAKHRVSPLPFALVEVTVPPEMLPEDLDEIVLPKAVTCADLPCFPGVTCEPSQDDRVKCGRCPYGYYGDGFNCRAICRQTCGKNMECVAPNICKCKPGYAGYNCQTALCRPDCKNHGKCIKPNVCECLPGYSGSTCEEAYCKPSCKNGGTCLARNLCTCPYGFVGPRCDTTMCDPVCLNGGSCTKPGVCLCPHGFYGARCRNAVCLQECKNGGECIGPSTCHCPPQWEGIQCQTPVCNQKCLFGGKCVSPNVCSCRPGYTGVLCGKKVQVQRRRG

SEQ ID NO: 250 - protein, 382 aa, Xenopus laevis
MEVLWMLLVLLVLHLSSLAMSLSTCKAVDMEEVRKRRIEAIRGQILSKLKLDKTPDVDSEKMTVPSEAIFLYNSTLEVIREKATREEEHVGHDQNIQDYYAKQVYRFESITELEDHEFKFKFNASHVRENVGMNSLLHHAELRMYKKQTDKNMDQRMELFWKYQENGTTHSRYLESKYITPVTDDEWMSFDVTKTVNEWLKRAEENEQFGLQPACKCPTPQAKDIDIEGFPALRGDLASLSSKENTKPYLMITSMPAERIDTVTSSRKKRGVGQEYCFGNNGPNCCVKPLYINFRKDLGWKWIHEPKGYEANYCLGNCPYIWSMDTQYSKVLSLYNQNNPGASISPCCVPDVLEPLPIIYYVGRTAKVEQLSNMVVRSCNCS

SEQ ID NO: 251 - protein, 171 aa, Xenopus tropicalis
GQGGCATCSDYNGCLTCKPQLFFALVRNGMKQIGVCRPSCPNGYFGIRSPEINKCTKCKADCETCFNKNFCTKCKSGFYKHNGKCLDTCPEGFENNHNMECTSVVHCVVGEWSAWGPCTKRGKTCDIKRGNETRVREILQYPSPRGTPCPPTSETKKCVVKRKKCQDSQDR

SEQ ID NO: 252 - protein, 209 aa, Xenopus tropicalis
MDTNHPGSAGGRGGLGSIFGGGSPGYSHSDLAGVPLTGMSPLSPYLNVDPRYLVQDNDEFILPTGANKTRGRFELAFFTIGGCCMSGAAFGAVNGLRLGFKETQNMAWSKPKNVQILNMVTRQGALWANTLGSLALLYSAFGVIIEKTRGAEDDLNTIAAGTMTGMLYKSTGGLRGVARGGLAGLALTSAFALYNNWEHIKGSSSRLSL

SEQ ID NO: 253 - protein, 601 aa, Homo sapiens
MAALTPRKRKQDSLKCDSLLHFTENLFPSPNKKHCFYQNSDKNEENLHCSQQEHFVLSALKTTEINRLPSANQGSPFKSALSTVSFYNQNKWYLNPLERKLIKESRSTCLKTNDEDKSFPIVTEKMQGKPVCSKKNNKKPQKSLTAKYQPKYRHIKPVSRNSRNSKQNRVIYKPIVEKENNCHSAENNSNAPRVLSQKIKPQVTLQGGAAFFVRKKSSLRKSSLENEPSLGRTQKSKSEVIEDSDVETVSEKKTFATRQVPKCLVLEEKLKIGLLSASSKNKEKLIKDSSDDRVSSKEHKVDKNEAFSSEDSLGENKTISPKSTVYPIFSASSVNSKRSLGEEQFSVGSVNFMKQTNIQKNTNTRDTSKKTKDQLIIDAGQKHFGATVCKSCGMIYTASNPEDEMQHVQHHHRFLEGIKYVGWKKERVVAEFWDGKIVLVLPHDPSFAIKKVEDVQELVDNELGFQQVVPKCPNKIKTFLFISDEKRVVGCLIAEPIKQAFRVLSEPIGPESPSSTECPRAWQCSDVPEPAVCGISRIWVFRLKRRKRIARRLVDTLRNCFMFGCFLSTDEIAFSDPTPDGKLFATKYCNTPNFLVYNFNS

SEQ ID NO: 254 - protein, 1963 aa, Salmonella typhimurium
MNPMQKKKLISIAIALTLQSYYIPAIAAENNDDEKECPSNISSLPKEKRAKLSPTCLATPENDNHWGWVAGGVAALVAGVAIGVENNGGGDSNHSYTPPKPDNGGDVTPPDDGGNVTPPDDGGNVTPPDDGGDDNVTPPDDSGDDDVAPPDDSGDDDVTPPDDSGDDDVTPPDDSGDGDVTPPDDSGDDDVTPPDDSGDDDVTPPDDRGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSDISGAGSTGTVIDGNNARVNNDGDMTITDGGTGGHITGDNVVIDNAGSTTVSGADATALYIEGDNALVINEGNQTISGGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVSVSGDSNAVDITGNVNISADYGQDDLAAGAPPLTGVVVGGNGNTVTLNGALNIDDNDLSATGGQYLDVVGLSVTGDDNDVEIDGGINITHSEDPLDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGSEVSNSGDILVYATSSNSSEDRAAITRASGEGSAVHNKAGGDITLISDQTPQGSGGIEVYPLKWYTHTFYAMMASDYGDVVNDEGATIHLQGAGVYGVTASRGKALNEGNIYLDGLVPTLDDENNITSTSYWQPSSLYLTSSGMVAGSTDADGDATAINTGNITVNNAGFGMMALNGGTAINQGVITLTADDGVTGQADELVGMAALNGGVVINDTSGVINIDADYGQAFLSDSSSYIINNGSINLNGSPMDDTDSHMGGTPTDKIWIQSLPGSGDSDTRTSDTGFFTAGTLANYGTETLNGDVDVNGGWLYNEAGASLTVNGTVTINGGANALANYGTLDADAISTWHSLFNEADGSITTDLLTLNGDVTFYNNGDFTGSIAGTSYQQEIVNTGDMTVAEDGKSLVSGSFYFYNEEDATLTNSGSAVEGGENTIINLTRANDSLTQVNSGTITATNGYSAITTVNGSNDPKWIWNTATGVINGINPDAPLINLGRGYNFGNQGTINVQGDNAVAISGGTSSYVINLVNSGTINVGTEQGKEDGTNGTGLIGIKGNGNATTINNTADGVINVYADDSYAFGGKTKAIINNGEINLLCDSGCDIYAPGTTGTQNDHNGTADIVIPDATTAPTEGSIPTPPADPNAPQQLSNYIVGTNADGSSGTLKANNLVIGDNVKVDTGFTSGTADTTVVVDNAFTGSNIQGADNITSTSVVWNAQGSQDADGNVDVTMTKNAYADVATDSSVSDVAQALDAGYTNNELYTSLNVGTTAELNSALKQVSGAQATTVFREARVLSNRFTMLADAAPQIKDGLAFNVVAKGDPRAELGNNTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQITLQFRSEGAKTFTMMGDALKVTPYAGVKFRHTMEDGYKERTGDFNLSMNSGNETAVDSIVGLKLDYAGKDGWSATATLEGGPNLSYSKSQRTASLQGAAGQSFGVDDGQKGGGVNGLATIGVKYSSNDTALHLDAYQWKEDGISDKGFMLNVKKTFR

SEQ ID NO: 255 - protein, 993 aa, Danio rerio
MATKCKISYLSIMAYADKRPTFVETKKRQDQKTVVAELPVETDAETVRCFLGTSFGTEDREEAEKTHQPRFSHEGGVHLGDDVTRQVSLESTNETRQLGSFGAHRNEWVSVLYKAKEQPQQDADIEGMRHRHAGAVHQQHSNDADARDSPKEASCPVAPLFSLPPPPPSIKERSTSSHNNRHVQSCPDRGTRNDECLPLTGHCSLAQGARTDRQPYDNLPHPFPGASSGYQCHSEGSHSPQQRSSVSPQPSPSELLPPPLPSHISNTRDTRQKSANYKQDIVQRRVGEGGRRDQYQLLQQPCYNQQRDPSFKPLLPNSSQGHVNEREEAEKERQLIEPQAQLLLGSSLPINYCIGGSGLQQQHSDRDSRYQEGKIALCQPYRCERALERNSSVSSSEASSPPYGSSSQLWPEPHDKEEKKNRAGKHKAHAERTKLSHAGSKASVSESSHSLPQIAMNSCKYNGGVVRPLGSLAASRRNLAEHDSETQPLQTLHSSGLEVVVSKGGGEDPSKASNESLVRESGNAPQKKNKDIGYKLGHRRALFEKRKRLSDYALIFGMFGIVVMVTETELSWGVYTKESSYSFALKCLISLSTVILLGLIIMYHAREIQLFMVDNGADDWRIAMTYERIFFIVLELLVCAIHPIPGQYVFTWTARLAFTYVPSVADADVDIILSIPMFLRLYLIGRVMLLHSKLFTDASSRSIGALNKINFNTRFVMKTLMTICPGTVLLVFSISSWIIAAWTVRVCERYHDKQEVTSNFLGAMWLISITFLSIGYGDMVPHTYCGKGVCLLTGIMGAGCTALVVAVVARKLELTKAEKHVHNFMMDTQLCKRVKNTAANVLRETWLIYKHTKLVKKIDHAKVRKHQRKFLQAIHQLRSVKMEQRKLNDQANTLVDLAKTQNVMYDLVSELQERSEELDKRIGTLEDKLDAVTGSLQALPCLISQAITQQQQDLLDGFVHRFRPPSLGSDRSWTPSRRRRSPSTAPHTSSDSG

SEQ ID NO: 256 - protein, 2432 aa, Canis familiaris
MGGSRPAASSCSPHAWGSAGRAGRSEVFLEAPQAIPLDLAESLCSAVSQVLSHSSFYGESYVELNIIEVSSEFSLQLKFQTSKPQGLLFLAAGKNDYCIIELLSGNLRVRVNLGVGKQVLLSEQRLHMDDLVWHLVELYCFKNSISLVIDKHYETTGQIAGGMHNLHFQHGIYIAGHGGLDVAYLDEELPNFRGCMEDVVFNQREILASLRSYPSFKKVYEVSLGCSDEFFAGEDEAINFFSSRSYVTFPEWRVQGEGLLEFALQTATQQALLLFQSGREGNFVALEIVNGLLKAHVGRSKSNTQLSSFSLVSDNKWHVIQLKFTGGYLDLMVDEQAVRTLLPLQSKSFVSEGPLFVGGLDNHKGEEVKKLELASVPRKSARGISFKGCLRGLEVNSEKKALKSALVSKDIAVGCKVQSSDNENPFIMTTEYLHPSEVPLSTVVPEAGKPFIHHASSYFLSLNNLEVQEGGRAFLEQRHMKVDVASEDLGIHHSQILFKIEEMPLHGFLQIDVSPALGMEKAFTMLDLGQGKVWYVHDGSEEPRDFFTFSVSSNSKKEMALRLQGHVPYVFNITVLPVNDPPYLKLPEGNMLLLFENSKKRLTPNIIHVSDPDTDPLSLSFSVLGNFNLDAGFLENTNHPGKAINSFTHGDLRDGNIFYVHRGHRNSRILLRASDGELVSNTVVLRVMAVPWDFEVVIRTGAVVQQGGAVLITQSDLSVEVNGEPHEMETRYAITHPPQFGQIQRQGSSGEWKQVSTFSQRSIDRGRVRYHSTFRGLQLENITDHFKFKVNIEGKISEELMFPITVHWLKVILLKNVPLKVNKISRQILNSDHLQAVTEGVDVTQRELHFKLLTPPKKGKLLVGNKILKTNSIFSQQNISDSKISYEPQERLREDTQDTFRFLIVAKHIESKDYTFRINFEADKTRIIVTNKGLFVKEGEEKLITKSELFAQTLDNRTFQYKITRSPQHGKLKLVNFSDPLGSHDSITEFTDQDLEGERLMYVHDDSETQCDEFLLVASTAGPGQEGVVRHLDTEHLSIEIKVAISVELRNDEKPVRVVDKVFHVVRNGQRLLTLADLCYHDPDSDFDDGQLLYTRRGIPNGDLVRASDPTQKLYQFRQDDLREGRVLFRHKGADSARFVLFVTDGVHYTSSLLEVTVSDPYIQIANNTGLVVQRGEGSSLTASNLSVTTNQDVRTDHEIEFHMLQPPKHGRVLVNHSVSHTFSQHDLKQGHVIYRHDGSGKSDMFNLRVKVKEIYVEVSVYVQVYSESHQRHAQILLIKTLVVEEGKPVKLSRGRLQAVHEDNIPSEAMFTIRIPPMHGYLRKSLPEEGSLGGDAKSPLTFTQQDIDDGDIFYVQTVPGQQQDRFLLDVVNGFQAVNGIEILVDIVPKQIPLEVQNFTVQEGGSKTLLEDYLKIPNKYFEGVDCEFVLLKPPKHGYVENSNFPRVKLMKFTRKQVENELIYYVHDDSEELLDNFTVFANSSELGKQSLPQTLFVTVESVNDEAPVITVNKILQVWANSVTEITRGDLCAEDKDSSPQDLTYWVTPPSNGHLALQSFPGQSIQNFTQAQINKGQLIFVHTGIHVRGLYFRVTDGLNFAPRQIFSITARALTLSLEVNRGLSIFPGSTKPLSSGDLRAVTNDADSKGNRTVTFTVISAPRLGRLVRVNSDNSTEDVSVFTQNLVSEQVILYQHVDRENTGWTAEDSFTFTTSSPPAALSPEEFHITISYEVTEPGRQSRLLANTVRICTFTGAFVKEGGKVLIDQSNLDASNLLLKLPKSQRSSYEIWFQVISLPHHGTIIVGERNITKGKPNFSQYIVNKFGIIYLHDDSESLADNFTFAVWPKQKSKSITKPETDFLEEMFNITISPVNDQAPEIKTKGLRLKVLQGNRLVVGPENLRVEDLDSPPEEIRYMIIRSPNNGFLAMAHHPDIPIHHFTQADIDNSQVWFVQDGSPSSGVFYFSVTDGQHRPLYKLFHLDVIPISITLVNLTDLLLPQGQTTVPITNIHLSATTNGRSPQITYKMTWPLQHGHLLVENQKVISFGQEDLYSGRLFYHMTNLTASEDQLYFSLFTSESNLTGQMLNIRVQPLLCVMSNLTVTNREVYHLKRKDLDATELANRTNSDPKFEVIASAAHGRLVRRVGQGMAIENTTLFTQSDINQGLLMLHPYANLTGIDMLNDSFTFLLKADHVQPAIGYLPFTIVPPDPLCLQTFTPDVSLLATADNLVTSDHSQEKPVVSSGPTAKTETLGKLTQTMQQEADPWGQHHGEEPTLDGKTSLTRVIWPPDTTSASPGAPTEPRENSYPLMVIVPLAMVVFLLIVTAVALCVWLLGQKVEKTKPLIKPQTSLEPTTPSPRPERSITVPTVTVTPLLKSSSSPPVSLFRDPQNEQMASPATEPVEKCAPWETWMNLDPDMVNLCRQTNPTLKHNQYWV

SEQ ID NO: 257 - protein, 1118 aa, Mus musculus
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHLPHDLFTELDEICWREGEDAEWRETARWLKFEEDVEDGGERWSKPYVATLSLHSLFELRSCILNGTVLLDMHANTIEEIADMVLDQQVSSGQLNEDVRHRVHEALMKQHHHQNQKKLANRIPIVRSFADIGKKQSEPNSMDKNAGQVVSPQSAPACAENKNDVSRENSTVDFSKGLGGQQKGHTSPCGMKQRLDKGPPHQQEREVDLHFMKKIPPGAEASNILVGELEFLDRTVVAFVRLSPAVLLQGLAEVPIPSRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPFFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSETYPINMHNDLELLTQYSCNCMEPHSPSNDTLKEWRESNLSASDIIWGNLTVSECRSLHGEYVGRACGHGHPYVPDVLFWSVILFFSTVTMSATLKQFKTSRYFPTKVRSIVSDFAVFLTILCMVLIDYAIGIPSPKLQVPSVFKPTRDDRGWFVTPLGPNPWWTIIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQLFDRIKLFWMPAKHQPDFIYLRHVPLRKVHLFTVIQMSCLGLLWIIKVSRAAIVFPMMVLALVFVRKLMDFLFTKRELSWLDDLMPESKKKKLEDAEKEEEQSMLAMEDEGTVQLPLEGHYRDDPSVINISDEMSKTAMWGNLLVTADNSKEKESRFPSKSSPS

SEQ ID NO: 258 - protein, 1905 aa, Xenopus laevis
MLLHAERPLPFHLWTFLVLLGSWIATGDGSPKDFRTFTGSDWSLTHLVVHNKTGEVYVGAINRIYKLSNNLTLLRTHVTGPVEDNEKCYPPPSVQSCPHGLITTNNVNKLLLIDYSDNRLIACGSASQGICQFLRLDDLFKLGEPHHRKEHYLSSVNESGTMSGVIIEVPNGQNKLFVGTPIDGKSEYFPTLSSRKLLGNEENAEMFGFVYQDEFVSSQLKIPSDTLSKFPTFDIYYVYSFSSEQFVYYLTLQLDTQLTSPDSTGEQFFTSKIVRLCVDDPKFYSYVEFPIGCMKDGVEYRLIQDAYLSKPGKRLAKELGISEREDILFTVFSQGQKNRIKPPKESVLCLFTLKKIKDKIKERIQSCYRGDGKLSLPWLLNKELGCINSPLQIDDNFCGQDFNQPLGGTVTIEGTPLFLDKEDGMTSVAAYDYRGHTVVFAGTRSGRVKKILVDLSASSSHLVQQYENVVVHEGNAILRDLVLSPDRQYIYAMTEKQVTRVPVESCEQYESCDTCLGSRDPHCGWCVLHNMCSRKDKCERADELHRFTSDQRQCVQLTVHPKNISVTVSEVPMVLQAWNVPDLSAGVNCSFEDFTEMEGRILDGKIYCTSPSAKEVIPITRGHGDKRVVKLYLKSKETGKKFASVDFVFYNCSVHQSCLSCVNGSFPCHWCKYRHVCTHNAADCSFQEGRVNMSEDCPQILPSSQIYIPVGVVKPITLTAKNLPQPQSGQRNYECIFHIPGSVTRVTALRFNSTSIQCQNTSYNYEGNDISDLPVNLSVVWNGHFVIDNPQNIQAHLYKCSALRESCGLCLKSDRRFECGWCVSEKKCTLRQNCPTLENPWMHASTANSRCTDPKITKLFPETGPRQGGTRLTITGENLGLRFEDIRFGVRVGHVMCVPVESEYISAEQIVCEINDAGRTRVHEAQVEVCVKDCSQDYRAISPKSFTFVLPSFNRVTPSRGPLSGGTWISIEGNYLNAGSDVSVAIGGRPCMFSWRTAKEIRCKTPQGPSTGKAEIQILINRATMNNSEVHYNYTEDPTVQKIEPEWSIASGGTPLIVTGMNLATIKEPKIRAKYGDVEKENNCTLYNDTTMVCLAPSVDNPLRSPPENGDRPDEIGFIMDNVHALLIVNTTSFLYYPDPVFEPLTASGNLELKPSSPLIIKGRNLIPAAPGNFRLNYTVLIGDTPCALTVSETQLLCESPNLTGQHKVTIKAGGFEYSPGTLQIYSDSLLTLPAIIGIGGGGGLLLLIIIIVLIAYKRKSRDADRTLKRLQLQMDNLESRVALECKEAFAELQTDIHELTNDLDGAGIPFLEYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLHCAIKQQMEKGPIDAITGEARYSLSEDKLIRQQIDYKTLNPCADDVGLSDESCCRSPQTLNCVNPENENAPEIPVKVLNCDTITQVKEKLLDAVYKGVPYSQRPKAGDMDLEWRQGRMARIILQDEDVTTKIDNDWKRLNTLAHYQVTDGSSVALVPKQNSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQITDYDVRHTWKSNCLPLRFWVNVIKNPQFVFDIHKNSITDACLSVVAQTFMDSCSTSEHKLGKDSPSNKLLYAKDIPNYKSWVERYYADIAKMPVISDQDMSAYLAEQSRLHLSQFNSMSALHEIYSYITKYRDEILTALEKDEQARRQRLRSKLEQVIDTMAQSS

SEQ ID NO: 259 - protein, 340 aa, Gallus gallus
MNTMKTTYIVLELIIAVLSIAGNVLVCWAVAINSTLKNATNYFLVSLAVADIAVGLLAIPFAITISIGFQVDFHSCLFFACFVLVLTQSSIFSLLAVAIDRYLAIKIPLRYNSLVTGKRARGLIAVLWLLSFVIGLTPLMGWNKAMSGCPNSTNETGADHGAGHHGCFISCLFENVVTMSYMVYFNFFGCVLLPLIIMLGIYIKIFMVACKQLHQIELMGNSRTTLQKEVHAAKSLAIIVGLFAFCWLPLHILNCITHFHEEFSKSKPEWVMYVAIILSHANSVINPIIYAYRIRDFRYTFHKIISKILCKTDDFPKCTTDNNQHLTVTNVNAPAASVTI

SEQ ID NO: 260 - protein, 754 aa, Bordetella bronchiseptica RB50
MSEQKSNQRSGGAQHSTHASRRRPILRHAPLALAIAALGAAQAQTASPQEDTLGITQMDTVVVTASGFEQEIKNAPASISVITREQLESKPFHNLADAVADVEGVSVERGGKAGGMNISIRGLPSDYTLVLVDGKRLSQNSSGARPNGFGDVDTNFIPPMSAIDRIEVVRGPMSTLYGSDAMGGVINIITRKVAREWTGQVTLDGTAQGDNRYGNNYGSSFYLSGPLQTDKLGLSLRGGLYRRLSAHGSYPANQAEYDSGDYSGDIASFSGLGDSLQRNVGLRLALTPNRNHDILFDVDANWQTFDNANGELGTLNADVAPNRQGGGYEPEMKFNRQRYALTHLGRYDGAISSDTSLLYDTTETIGRTNPMSTPRQPSDGEKRELEYENWVFDTKWTMPLFNDRHNLTMGGQWREQKFKDTLVSAPLNLRQYQWALFAEDEWRIVDDLALTMGARYDRNEQFGGKWSPRGYLVWNATPAWTVKGGVSKGYKTPDINLMTDGIIGLGAQGTMPLLGNSQLKPESSTSSELGVLFDDGEGLTGNLTGFHTKFKDKIDTQNVPNCLAAGGPVPGCLDLGVWERNGVPVANFSQRVNVDTATIQGFELGGRIPLFEGWSFSGNYTLTASEITSGAKQGQPLGSQPRHSLNLGLNWRVNERFNAWVRGEYRAKQFNDMNWEKEQVFYSPYWLASLGGSYVLNKNVTLSASVYNLFDKNFVDYGPTKVGTSAPTAATSWSNSYRQVLEGRRLWVSANITF

SEQ ID NO: 261 - protein, 1026 aa, Magnetococcus sp. MC-1
MNLARISVARPVFTSMVTLMVVILGLVSLSRLQIDLLPSIELPTLSVRTQYEGASPEVMERLVTQIVEEIVATVPGVVEMTSQSSEGNSTVKVSFAWGTDIDTAALDVLATLEDEINELPEDITRPRVSKFDVDSFPVVILGISSDLDPVPFTQLIEEQIRYRFARIAGVAQVDVWGGYNRQVRIELDPDRLNALGIPLADVLTAVRNANLDRPAGTLEEGQFEITLRAPAEFVDLDEIRQTVVVLRDGVPVTLGQLAAVHDRYEKLTRMVRVDDRPGIRVAIRKQAEANTVEVAKRVLAEIEAVNQAYPRIHVVPVINQGNFIERSIANVARSVLYGGGLAVLVLLFFLGSVRSTVVISLAIPISIIATFMLLYFGGFTLNLMTLGGLALGVGMMVDSSVVVLENIVRRRHEARESLHTASLMGAQEVTSAIIASTITTLVIFLPLVFVRGVSGILFQELAYVIIFSLICSLLVSLSLVPMLISKLGRGGEGSVDLPRWADRWQSAMQQSYANLLQRVLEHRWKTVLAAVTLLAGSMLLLPYIGTEYLPPSDEGEVRITGEMAVGTRLELLDQQAQRMEAIVRQAVPEIQSSVVNVGRWRGKTNAEIRLALAPVAERSRSNVEIAADLRRRLAGQIPGMKVRTRAPQGQFLLERLLAAEEGITIEVRGYDLQVLDGLAQAAMAAIADLPGVTDSEASKIAGVPQRGIHIDRAKIADLGLSVQDVTSAIETAVAGSKAGEFRAAGNAYPILVQLADAEKRGLDEILDLTLRTPAGELVAIRNLVSTVAGQGPLVIDRKDQQRLVTVSANVAGRDLGSVAAEVQERLMLIPRPAGYDLLLSGHYEEQGKAFRELIISMLLALVLVYMVLASQYESLRDPIIVMLSVPMAAVGVLLMMFLTHTTFNLQTFIGCIMLVGIVVNNAILLVDQAGRLRQAGMSGKQAVTEAGRRRLRPILMTTLTTVLALLPLALGIGEGADMQAPLARAVISGLAGSMLITLVIIPVVYTLFHPDPAPGSTQPAVEASVP

SEQ ID NO: 262 - protein, 479 aa, Xenopus tropicalis
MDIRGAVDAAVPTNIIAAKAAEVRANKVNWQSYLQGQMISGEDCEFIKRFETSLPEDKQIILTNEGNQCAKTFINLMTHISKEQTVQYILTMVDDMLQENHQRVSIFFDYARRGKNTAWSYFLPMLNRQDLFTVHMAARIIAKLAAWGRELMEGSDLNYYFNWIKTQLSSQKLRGGVSAVETGTVSPSDSSQYVQCVAGCLQLMLRVNEYRFAWVEADGVNCIMSVLSNKCGFQLQYQMIFCLWLLAFSPQMCEYLRRYNIVPVLSDILQESVKEKVTRIILAAFKNLLEKSTERETRQEYALAMIQCKVLKQLENLEQQKYDDEDIVEDIKFLLEKLGESVQDLSSFDEYSSELKSGRLEWSPVHKSEKFWRENAARLNEKNYELLKILTKLLEVSDDPQVLAVAAHDIGEYVRHYPRGKRVIEQLDGKQLVMNHMHHEDQQVRYNALLAVQKLMVHNWEYLGKQLQSEQAPAVAARS

SEQ ID NO: 263 - protein, 750 aa, Xenopus tropicalis
LAFIYAIEEINSNKNILPNVSLGYIIYDACSNEVIALDRIFRILSEINEALPNYSCQKRHKPVAVIGHSLSSTTYTIAQITQLYGYSQLSYGAMDPVFNDQTLFPSVFRTVPNEYLQFEVIVQLLIHFKWKWVGIVSSDDISNHKASLELIKEMKNRGICVEYHIVIPASANVNMSHILKLIQQSTATVIILYCTLLQIINLTKLWHTDESQITGKVFLTSVALNAIDDYIYMESFVTLNGSLLISVHKGEIPGFMSYLFHRDWERMPDKNFVNNFKMFLKCFTVPSNDSQSRCLLFHNWKNTNYVTSVIYNTVHILAQALHQMRLDRALFDTESKDLAAESKYKLNRYLKKVHLKSLSDEIFFNEQGSVAGKFDILNLIIESKNQIRKIPVGSFVPSASPKLIINESAIVWNPCFKKTPVSLCNDICPTGYRKAIEKGKFPCCYDCIRCSEGEIASSPDTENCLQCPEDHWSNPSRDFCLRKAVDFLSYGNCLGMVLATAALLFSVCTGAVLWLFIKNRSSQIVKANNRNLSYILLVSLFLSFCCCFLFIGRPVPITCILRQTAFLFLYTVAISSLLGKTLTVIIAFHATKPGTRLRKFVGSRVSISLVLLCSLGKLAICSTWLIWATPFVALDTKTTQQTMTLWCNEGSIATFCVAVSYTAVLALLSFIVAFMARTLPDRYNEAQHITFSMLVFFSVWASFIPTYLSTKGKYMVAVEIFAILASTAGLLFCVFVPKCYIILLKGNLNT

SEQ ID NO: 264 - protein, 599 aa, Homo sapiens
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 265 - protein, 1484 aa, Homo sapiens [sequence omitted]

SEQ ID NO: 266 - protein, 1332 aa, Homo sapiens [sequence omitted]

SEQ ID NO: 267 - protein, 321 aa, Rattus norvegicus
MNLQRANKFKITETNITIPIEFVLLGFSDIPKLHWLLFGIFLFIYTIILLGNGIIILITRVDPSLQTPMYFYISNFSFLEIYYVSVTLPRMLMDLFTLKGNISFLACATQMCLFLILGATECFLLAVMAYDRYVAICNPLHYPVVMSTKLCTQLVIASWVIGIPIQVGQTYQILSLPFCDSNQINHFFCDIPPLLKLACGNIFVNEIVVFIFAILIVTVPFMLILASYSRIISTILKLPSNTGRTKAFSTCSSHLIVVILFFGSGSVTYLKPKSSKYEGTDKLLSLFYTVFTPMFNPLIYSFRNKDVTGALRKLFTKFLAL

SEQ ID NO: 268 - protein, 624 aa, Xenopus tropicalis
MVSIWKWILANRNYFIIFLVPLFLLPLPLVVPTKEASCGFVIIVMALFWCTEALPLAVTALFPVLLFPMMGIMDSTAVCSQYLKDTNMLFIGGLLVAISVEKWNLHKRIALRVLLIVGVKPALLLLGFMVVTAFLSMWISNTATTAMMIPIAQAVLQQLHTSEERVDKPSEETKKNVNGMDNSMYESVLPNGKMILAVENTYATVNEGFEMQDSTKDPEPSKLEKESIGPIVIELEDEKQKEEKQKLRLEKHLKICKGMTLSVCYSASIGGIATLTGTTPNLVMKGQMDELFPENNNVINFASWFGFAFPTMFVLLALSWLWLQFMFLGFNFKKNFGCGGNSEQKEKEKRAFKIISGEHKKLGAMTFAEISVLVLFILLVLLWFTREPGFMPGWATISFNKDGKEMVTDATVAIFVSLMMFFFPSELPSFKYREDTDTEKPGMKPKFRVPPALLDWKTVNEKMPWNIVILLGGGFALAKGSEESGLSLWLGEKLTPLQSIPPAAIALILCLLVATFTECTSNVATTTLFLPILASMAKAIHLNPLYIMLPCTLSASLAFMLPVATPPNAIAFSYGQLKVIDMAKAGLLLNILGVLTITLAINSWGFYMFDLGTFPSWANSTGQP

SEQ ID NO: 269 - protein, 1238 aa, Homo sapiens [sequence omitted]

SEQ ID NO: 270 - protein, 3623 aa, Homo sapiens
MMNMSLPFLWSLLTLLIFAEVNGERGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGNCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMSSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRYHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIISSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDIYSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSWLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 271 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 272 - protein, 2022 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 273 - protein, 341 aa, Homo sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 274 - protein, 496 aa, Homo sapiens
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAELFSQGPRPAAMAVAGCSNWTSNFLVGLLFPSAAHYLGAYVFIIFTGFLITFLAFTFFKVPETRGRTFEDITRAFEGQAHGADRSGKDGVMEMNSIEPAKETTTNV

SEQ ID NO: 275 - protein, 599 aa, Homo sapiens
MATNGSKVADGQISTEVSEAPVANDKPKTLVVKVQKKAADLPDRDTWKGRFDFLMSCVGYAIGLGNVWRFPYLCGKNGGGAFLIPYFLTLIFAGVPLFLLECSLGQYTSIGGLGVWKLAPMFKGVGLAAAVLSFWLNIYYIVIISWAIYYLYNSFTTTLPWKQCDNPWNTDRCFSNYSMVNTTNMTSAVVEFWERNMHQMTDGLDKPGQIRWPLAITLAIAWILVYFCIWKGVGWTGKVVYFSATYPYIMLIILFFRGVTLPGAKEGILFYITPNFRKLSDSEVWLDAATQIFFSYGLGLGSLIALGSYNSFHNNVYRDSIIVCCINSCTSMFAGFVIFSIVGFMAHVTKRSIADVAASGPGLAFLAYPEAVTQLPISPLWAILFFSMLLMLGIDSQFCTVEGFITALVDEYPRLLRNRRELFIAAVCIISYLIGLSNITQGGIYVFKLFDYYSASGMSLLFLVFFECVSISWFYGVNRFYDNIQEMVGSRPCIWWKLCWSFFTPIIVAGVFIFSAVQMTPLTMGNYVFPKWGQGVGWLMALSSMVLIPGYMAYMFLALKGSLKQRIQVMVQPSEDTVRPENGPEHAQAGSSTSKEAYI

SEQ ID NO: 276 - protein, 310 aa, Xenopus tropicalis
MDGENQTTIQSILLLGFQMPPHFKIPIFILIFLLYSLTLTGNLLIISLIYGSPTLQHPMFFFLTHLSLSDICLTTDIVPNMLYVIKSGPISITMAACMTQFQFFGTVVTFECLLLAVMSYDRQLAICNPLRYASIMGNQLPLWLVIVCWSVRTFAISRLNFCGPNIIDHFFCDFFPILQLSCSDTSAVELEQILIAVPTVVMPVVFIVGTYICIFIAVLKIPSTSGRQKAFSTFSSHLSVVCIFFGSLICLYVAPPSGNFLSTNKVVSVLYTVVTPLSNSIIYSLRNSELRSAFKKHVNIYNICKMSKLS

SEQ ID NO: 277 - protein, 900 aa, Danio rerio
MTTSEDRGGRTLVTHLEVTEPAATHPATTLAAASSPEVPINDTAALQDVVEGPTVPEEVSCQLQGCFKLNGMYQDGEFIIGGLFEVQNLKVFPELSFTNEPELPQCEEFYMASFQQALTMVFAINEINSNSKLLPNITLGYQIYDNCLRLGVAFRAAMSLVSGTEESSNLSCTGPPPVIGIVGDPGSTQSITISSVLGLYRVPMVSYYATCSCLSDRKKYPSFFRTIPSDAFQVRAMVQILRHFGWTWVGLLYSNDDYGIYAAQSFQQEMQILGGCVAFSEMLPYDNNGRDIQRIAGVIQKSTAKVVVAFSTDLASLMDELLLQNVTGKQWIASEAWTTTPVLQTPQYLPLLGGTLGIAIRRGQIQGLYEFLKNLRPDKNPKNSTIRIFWETMFGCKFEVGGKKVDEQQERGRNKCSGQEDLNNSETAYTDVSELRASYNVYKTVYALAHALHDLVKCEEGKGPFTGNSCADISNLKPWQLVHYIQNVKFTTGFGDHVSFDENGDALAIYDVMNWHPRSDGSIIVHVVGVYEEAILGKVLTLDEDALFWNFETKKPPDSVCSESCPPGTRRARKKGLPVCCFDCLPCGDGEISNTTDSPECFICPEDFWSSPENDRCVPKEMEFLSYDDPLGISLTTASLLGTCFCVLVLVIFAYHHNTPVVRANNSELSFLLLVSLKFCFLCVLLFIGRPRLWTCQLRHAVFGISFVLCISSILVKTMVVIAVFKTSRPEGKTSIKWFGSAQQRGTVIALTSAQVAICTVWLSSASPTPHKNNQYIHSKIVYECAIGSVAGFSLLLGYIGLLAAVSFLLAFMARKLPDNFNEAKFITFSMLIFCAVWIAFVPAYASSPGKYAVAVEIFAILASSFGLLAAIFAPKCYIIILHPERNTKKAIMGRSTQNK

SEQ ID NO: 278 - protein, 337 aa, Mus musculus
MYHPAYWIVFSATTALLFIPGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKGQGFVSEDEYLEISDIKRDQSGEYECSALNDVAAPDVRKVKITVNYPPYISKAKNTGVSVGQKGILSCEASAVPMAEFQWFKEDTRLATGLDGVRIENKGRISTLTFFNVSEKDYGNYTCVATNKLGNTNASITLYGPGAVIDGVNSASRALACLWLSGTFFAHFFIKF

SEQ ID NO: 279 - protein, 1090 aa, Homo sapiens
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 280 - protein, 1095 aa, Mus musculus
MSVSIPSNSVPSSASRFQVHVINEGHGSAAAVGDSADPPHYEETSFGDEAQNRLRISFRPGNQECYDNFLQTGETAKTDTTFHAYDSHTNTYYLQTFGHNTMDAVPKIEYYRNTGSVSGPKVNRPSLLEIHEQLAKNVTVAPGSADRVANGDGMPGDEQAENKEEDMTGVVKFGWVKGVLVRCMLNIWGVMLFIRLSWIVGEAGIGLGVIIIGLSVVVTTLTGISMSAICTNGVVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPSFTKGEGFFSVFAIFFPAATGILAGANISGDLEDPQDAIPRGTMLAIFITTVAYIGVAICVAACVVRDATGSMNDTIVSGMNCNGSAACGLGYDFSRCQHEPCQYGLMNNFQVMSMVSGFGPLITAGIFSATLSSALASLVSAPKVFQALCKDNIFKGLQFFAKGYGKNNEPLRGYFLTFVIAMAFILIAELNVIAPIISNFFLASYALINFSCFHASYAKSPGWRPAYGIYNMWVSLFGAILCCAVMFVINWWAAVITYVIELFLYIYVTYKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLSELENYVGIIHDAFDFEIGVVIVRISQGFDISPVLQVQDELEKLEQERLALEAAIKDNECEEGKGGIRGLFKKAGKLNITKPAPKKGGNISSIQSMHVGEFNQKLVEASAQFKKKQGKGTIDVWWLFDDGGLTLLIPYILTLRKKWKDCKLRIYVGGKINRIEEEKISMASLLSKFRIKFADIHIIGDINIKPNKESWKVFEEMIEPYRLHESHKDLTTAEKLKRESPWKITDAELEAVKEKSYRQVRLNELLQEHSRAANLIVLSLPVARKGSISDLLYMAWLEILTKNLPPVLLVRGNHKNVLTFYS

SEQ ID NO: 281 - protein, 452 aa, Homo sapiens
GTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANVDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPERSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 282 - protein, 774 aa, Homo sapiens
MNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRLAVQLNPDQAQAWMNMGGIQHIKGKYVSARAYYERALQLVPDSKLLKENLAKLDRLEKRLQEVREKDQT

SEQ ID NO: 283 - protein, 998 aa, Bos taurus
MGRPERGALRPLALLLLLLQLQHLAAAAADPLHGGQGSVKECDENQFRCRNERCIPSVWRCDEDDDCSDNSDEDDCPKKTCADSDFTCNNGHCIRERWKCDGEEDCPDGSDESEATCTKQVCPAEKLSCGPTSHKCVPASWRCDGEKDCESGADEAGCATLCAPHEFQCSNRSCLAAVFVCDGDDDCGDGSDERGCADPACGPREFRCSGDSGACIPERWVCDRQFDCEDRSDEAAELCGRAGPRATPAPAACAAAAQFACRSGECVHLGWRCDGDRDCKDKSDEADCPLGTCRGDEFQCGDGTCVPAIKRCNQEQDCPDGSDETGCLQESTCEGPRRFQCKSGECVDGRKVCDAQRDCRDWSDEPLKECGLNECLHNNGGCSHICTDLKIGFECTCPAGYQLLDQKTCGDIDECEDPDACSQICVNYKGYFKCECHPGYEMDTLTKNCKAVAGRSPSLIFTNRHEVRRIDLVKRDYSRLIPMLKNVVALDVEVATNRIYWCDLSYRKIYSAYMDKASNPVEQDVLIDEQLHSPEGLAVDWVHKHIYWTDSGNKTISVATVDGKRRCTLFSRNLSEPRAIAVDPLQGFMYWSDWGFQAKIEKSGLNGVGRQTLVSDGIEWPNGITLDLLNQRLYWVDSKLHQLSSIDFSGGNRKMLISSPDFLSHPFGIAVFEDKVFWTDLENEAIFSANRLNGLEISVLAENLNNPHDIVIFHELKQPRAADACELSAQPNGGCEYLCLPAPQISSHSPKYTCACPDTMWLGPDMKRCYRAPQSTSTTTLASTTARTLADTTRAPGTTNHSPTYQNHSTETPSLATEVPSSVSVPRAPSISPSTPSPATSNHSQHYGNEDGKMGSTVTAAVIGIIVPMVVIALLCMSGYLIWRNWKRKNTKSMNFDNPVYRKTTEEEEEDELHIGRTAQIGHVYPAAISSFDHPLWAEPCLGETRELEDPAPALKELFVLPGEPRSQPHQLPKNPLSELPVVKCKRVALSLEDDGLP

SEQ ID NO: 284 - protein, 596 aa, Gallus gallus
MALDACPDSFLHLPYRIDNVDQTSAHGRRDLVEPGFQEPSNRMSLNHQDDDVDLEALVNDMNSSFESLYSTCSMQSETTPLLQNGQLNRSPLPTSGSSALQPTSPRQKVQRSQPVRIMAVRRLQEEEQQFRTSSLPAIPNPFPELCSPASSPVLAPGSLPQSQPANKHDVKVFSEDGTSKVVEILADMSARDLCQLLVYKSHCVDDNSWTLVEHHPHLGLERCLEDHELIVQVESTMGSESKFLVRKNYAKYEFFKNPMNFFPEQMVAWCQQTNGSIPQSQLLQNFLNSSSCPEIQGFLHVKELGRKSWKKLYVCLRRSGLYCSTKGTSKEPRHLQLLADLEDSNIFSLIAGKKLYNAPAEYGFCIKPNRVRNETKELRLLCAEDEQSRTCWMTAFRLLKYGMLLYQNYRIPQQRKAMLPHFSTPVRSVSENSLVAMDFSGQIGRVIENPVEAQSAAMEEGHAWRKRSTRMNILGSQSPLHPSTLSTVIHRTQHWFHGRISREESHRIIKQQGLVDGLFLLRDSQSNPKAFVLTLCHHQKIKHFQILPCEDDGQIFFSLDDGNTKFSDLIQLVEFYQLNKGVLPCKLKHHCIRVAL

SEQ ID NO: 285 - protein, 321 aa, Homo sapiens
MERKNQTAITEFIILGFSNLNELQFLLFTIFFLTYFCTLGGNILIILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 286 - protein, 1143 aa, Homo sapiens
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 287 - protein, 467 aa, Gallus gallus
MHSGNGTGATSRPQLAAAGHEVPGERPLFSAGTYELLALLIATIGTLGVCNNLLVLVLYYKFKRLRTPTNLFLVNISLSDLLVSVCGVSLTFMSCLRSRWVWDAAGCVWDGFSNSLFGGCRRSRPSDPCGPASLPAPCRPPGDPNGCGPRRQTGEGSCPLGGRIVSIMTLTVLAYERYIRVVHAKVIDFSWSWRAITYIWLYSLAWTGAPLLGWNRYTLEIHGLGCSMDWKSKDPNDTSFVLLFFLGCLVAPVVIMAYCYGHILYAVRMLRCVEDFQTSQVIKLLKYEKKVAKMCFLMISTFLICWMPYAVVSLLVTYGYSNLVTPTVAIIPSFFAKSSTAYNPVIYIFMSRKFRQCLLQLLCFRLMRFQRIMKEPSGAGNVKPIRPIVMSQKVGDRPKKKVTFSSSSIIFIIASDDTQQIDDNSKHNGTKVNVIQWKNTHDGLARALFVTLEMQEPETVKLSPNSQ

SEQ ID NO: 288 - protein, 513 aa, Gallus gallus
MESVSSSPSPFPDSSPSVPSGNATAHDHYSGLQKSLHVLSMVVYSIACVLGVTGNGLVIWIAGFKMKKTVNSVWFLNLAIADFIFTFFLPLSIAYTALDFHWPFGKLLCKLNSTIAFLNMFASVFLLMVISVDRCVSVAFPVWSHNRRSPELAARVALGTWGMAVLLSSPYLIFRDTAVSSRNITSCYNNFALSDDYTAEETRRLWRMRHKAMIITRFLCGFLIPFTVILICYSIVAVKLKRRQLASSAKPYRIIIAVTVSFFLCYFPYHVFSLLEISQNSSSHEMKMALYIGIPLVSSLAFFNSCINPILYVFVGPDFKEKFCQSILSTFEGAFTEESMLGSLSSRRKSSFALKALSDVISWVVLGFRNSLNPCYLQLLRKAQVGRPAGVCLIGPAEGRFCGQADSSIPTNRIGMGRAIWGVKPDTVTPEAGIGGGGLEAVLSMELLSVEVPTCCKASQQAQEGCVGQKISSKRLMHPLLYAARTLRGDFHNPDGDRCPPLTSARGKRETPR

SEQ ID NO: 289 - protein, 790 aa, Canis familiaris
MAAPSLLNWRRVSSFTGPVPRARHGHRAVAIRELMIIFGGGNEGIADELHVYNTVTNQWFLPAVRGDIPPGCAAHGFVCDGTRILVFGGMVEYGRYSNELYELQASRWLWKKVKPHPPSSGLPPCPRLGHSFSLYGNKCYLFGGLANESEDSNNNVPRYLNDFYELELQHGSGVVGWSIPVTKGIVPSPRESHTAVIYCKKDSGSPKMYVFGGMCGARLDDLWQLDLETMSWSKPETKGTVPLPRSLHTASVIGNKMYIFGGWVPHKGENIETSPHDCEWRCTSSFSYLNLDTAEWTTLVSDSQEDKKNSRPRPRAGHCAVAIGTRLYFWSGRDGYKKALNSQVCCKDLWYLDTEKPPAPSQVQLIKATTNSFHVKWDEVPTVEGYLLQLNTDLPYQAASSDSSAAPNMQGVRMDPHRQGSNSTIPNSVSDNSAKTEHTALKGTSVKNRPDLKASSDSNATLHSSLAANASNHNSCVVDVLRKNEGPHTSAYIGVLSSCLDLRTVVPETSVSSSVSSAQTMVTQQTIKTESSSTNGAVVKDETSLTTFSTKSEVDETCALPATKISRVEAHATAMPFSKETPSNPVATMKAGERQWCDVGIFKNNTALVSQFYLLPKGKQSISKIGNADVPDYSLLKKQDLVPGTGYRFRVAAINGCGIGPFSKISEFKTCIPGFPGAPSAVRISKNVEGIHLSWEPPTSPSGNILEYSAYLAIRTAQIQDNPSQLVFMRIYCGLKTSCIVTAGQLANAHIDYTSRPAIVFRISAKNEKGYGPATQVRWLQGNNKKAPLN

SEQ ID NO: 290 - protein, 312 aa, Xenopus tropicalis
MSFPIPVAVCSLVPTVTGLVVNAFITLVNIRNYLREQGLKPCDKILMALCLTRFLLQWTFLLDIIGILLQLIPFSTFAIYCIFYVVEQFLDYFSRWLAMWLSILYYVNITIFKNVLVLYLKSRIPHVTSYMIFVSAFLSFGPGLIYSLTSSEVSCLRVSNQSLSKNATYETKEFLSISFVFGQCLPSVIEMVSSIYLLWTLFAHVNYTKANVSSFTAPNMDAHWSAIRCILLLYFMSACNFIGNLILYFFSNDSFGSSLSYIITFAYPTLHSVVFVLNHSKLKKELAKILYCEKSVVGFRAETVVRSSLGQA

SEQ ID NO: 291 - protein, 818 aa, Gallus gallus
MGSLTSIYVFACVFLSILWNNIQPTVENKITANYSGHLLTEVPKNIPVHTHILDLSHNSISEITNFRFTSLSDLQVLNLSHNLITELDFSAFMFNQDLEYLDLSHNNIWTAYCQLLARLRHLDLSFNKFTVLPICQEFGIMFHLEYLGLSAMMIRRSDFRYVAHLQLDTVFLTLEDFSLYEPLSLTALNTRSLHIVFATNQNFNFSLLYDGMSTSEKLKIVNLRYTLSHKDFPSPSLELQKKIKATDLMLDTVDLEWTVILQIFLLVWDSSVEHLTVRNLIFRGPVVELTEYKHVPLLRSLEQLLSLGSSMKALTLERVRNKLYYFNQEILYRQFSEMNIDSLTIHDACMPHMLCPKKPSSFQYINFSRNALTDELFQNCDTLANLKILILHRNKFESLSKVSFMTSRMKSLRYLDMSSNLLRNSRAEGRCQWADSLAELDLSSNQLTEAVFECLPANINKVDLQNNQIANVPKGITELHSLQELNLASNRLADLPGCRAFTGLEILNIERNLILTPSADFFETCPSVKELQAGQNPFKCSCELQDFLRLERQSGGKLSGWPEAYVCKYPEDLSGTQLKDFHLTELACNTTLLLVTALLLTLVLVAVVAFLCIYLDVPWYVRMLWQWTQTKRRAWHDCPEERETALQFHAFISYSERDSLWVKNELIPNLEKGEGCIQLCQHERNFIPGKSIVENIINCIEKSYKSIFVLSPNFVQSEWCHYELYFAHHRLFSENSNSLILILLEPIPSYVIPARYHKLKALMAKRTYLEWPKERSKHALFWANLRAAVNIKLPTSFETDEEQSDVTSTSSITQRLIK

SEQ ID NO: 292 - protein, 1864 aa, Homo sapiens
MSQKSWIESTLTKRECVYIIPSSKDPHRCLPGCQICQQLVRCFCGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPSQPSCKSHLETGTKDQETVCSKATEGDNTEFGAFVGHRDSMDLQRFKETSNKIKILSNNNTSENTLKRVSSLAGFTDCHRTSIPVHSKQEKISRRPSTEDTHEVDSKAALIPVWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 293 - protein, 792 aa, Rattus norvegicus
MAYGFNLKNYQIVLAMVYAIEEINRNPHILPNVSLGYDIYNVLFNEWFTLHRCISWLSGPKKYVPNYTCRREMKSIAALTGISWIISTDIRTLLELYRYPQLTIGSFDPNLNNHEQFHDIYQIAYKDMSLTHGIVSLLNYFHWNWVGLIVSEGQNGFQIISEVRAEMDRNKICLDFVELIRVSEVSYLPSYLLNPTHLAKLTANVIITYGDSDFLRGFMFYSRQIFVTRKVWIMNSDWDIITQSQHFILHSLHGSLIFAHHHKETSGYRNFIQTVHPSKYPEDFYLTRFWFYFFNCSFADDDCSTLENCLPNASLHETPGNRFDMVMTEFAYNMYNAVYAVAHSLHKMLLHEVEVREVRKAEDLIFSAWQLHPFLKNMQFTNPAGEQVTLDEKMKLNAEYDILNYWNFPEGLHLKVKVGQFSPYGPLDQQLSLSEDIIEWPTEITETPRSVCSESCGPGFRKSLPEGKRICCFDCIPCPENEISNETDVDQCMQCLDHQYANTAQNHCLQKSMTFLHYEDPMGISLSCIALCFSALTSLVLGIFLKQKNTPIVKANNRTLTYILLIALNFCFLCSFLFIGHPNTVTCILQQTTFAVVFTVAVSTVLAKTITVVLAFKVTAPGRRIRWLLVTRAPNFIVPICTLIQIILCGVWLGNSPPFIDTDTHSENEHIIIMCNKGSVTAFYCVLGYLGALALGSFTLAFLARNLPDTFNEAKFLTFSMLVFCSVWVTFLPVYHSTKGKHMVVVEVFSILVSSAGLLGCIFAPKCYIILLRPQRNSLQSHRHKIHYKYMT

SEQ ID NO: 294 - protein, 267 aa, Danio rerio
MTTKELSVDLQDRIVSRHKAEEGYRKMPSLPSKNAENGSDRQHPNTRLMFPKILPHECGRIYKTLISKPSLVEKTLAPQAERFTMGSAEEDDQPRPSDITVFGANCTLHGLSHIFLPGGVTVRRLLWAAAFLSSLSIFLYQVAGAVMDYMSYPHVTILDEMDSPVMYFPAITLCNYNSFRRSKMVRNDLFWMAGMLGVEQNDFDDFMAALGQPPDNSKFFPSKTFNMLEFVQRTSHSIDEMLLDCKYRGKDCGPENFTTVSKPAEAD

SEQ ID NO: 295 - protein, 888 aa, Xenopus laevis
MLGAKMFLVLIYLTALRLTSISSQIQSKKPACHLEIIKTFEDYEYMKEGDIMIAGVLTVNTLILSFEYPMGLYDAMLCVGALAKNYRQFVDFLFAIEQINNNSDQLLNLTLGYHIYDSCGDARKAVRSVFQILSGINEPVPNYSCVDKRNIAGFIGDLSSETTVPIAQVLNVYGYAQISYGATDPLLSDRVAFPYFFRMVQSDHGHYLALSKLLKYFEWTWIGIIQFNDNSGEKQLQLLTNYLTMEGICVEFKIKLSNYIKDTPMYKMHKEIIQKSSTSVIILCGTASVTFVETFRNLTDVFRKKTLIISSTVTANHNLMDYYLEIFHCSLGFVQESVYSLDSPKMRSFLQSFHPLRYPEDKLLEHIWMQYHFCLSEDASKNDLYENVYKITLHNSTGQDNLTDILSTDSTMHFPLVHFAVNIIAGAVHKMHDSLTELISENKTTGHYYKHKLHLYLKNLRYKTLRNKTKIFNENGELISEYLIYNYIMDSGTHIVVNYLGVFNPWEMSDQKLEIISSDIRWKTNDSKIPRAQCSDKCLPGFRKAPRPGVQSCCYDCVPCPAGDISTTTDSERCARCPDKEWPNENKDQCITKTEEFLTFANDMMSVFFSTISVLIFLVTLLILGVFITYRDSPIVRANNRTQLLLLVSIKLSFLSVFLFLGRPVDITCMLRNITFGITFSIAVSSLLAKTIMVCVAFKATKPGSTWRKWVGAKLSYSVVLFCSSIQIIICMTWLAISPPFQELDLHTYPGTIIIQCNEGSAIGFYSVIGYMGLSYWLLSVIGYMGLLAAVSFVLAFLARTLPDSFNEAKYITFSMLLFCSVWITMIPAYLSTKGKNTVCVEIFAILTSSAGLLACIFLPKCYIILFTPEMNTKSHLLGNRIGSVILH

SEQ ID NO: 296 - protein, 849 aa, Mus musculus
MKLLIAFSLLIVLIIFQEQISCFSLNIPASPGYYQDGDFVIGGLFSLRVTAGDTRSRFGFTDTIHIPEYVYGDLTKHYQHMLAMVFAIEKINKDPNILFNMTLGFSLFNVDFIEMKAVESSVSLLSGESPPIPNYSCRPEKTDKLVAVIGGISTGISTQISQILSLYNVPQISYAPFDHSLGTRVQLQSPYQFPVHTTALYQGIIQLLLYFTWVWVGLVVPDDMRGELFLRDITEEMTNHGLCVAFAEKVPEFPAKDTVNRELFMERFTLTHVIVAFGDTYSLLRFVYNIFCNTPFGNIWITTSDWDITTLSFQQNLGYTYFGGGLSFFVHMDEILGFKDFLRDVQPRKYPHDIFIQDVWSILFECPYFEQHGIRELSQCEQNGSLSTRPLHVWDMNTSPMSYKVHAAVYAIAQALHEELSLRVEGGSLHKAPLPWKLHPFLQKGQLRRNTNEASMNKEVWTTELDIFNYQSLQSGTKAQVKVGEFVFGSHSVQHLSLNDKLITWGEHHSQTPLSVCSQSCPFGYRKTPIEGKPFCCYDCIPCPDGEIANETDMDQCIKCPEDQYPNKQRNQCLPKIMAFLSHEDTLGALLVCTAISLSAFAAMILGLFIHYRDTPIVRANNRNLSYLLLVSLMLCFFCSLIFIGQPGTVTCVLRQMIFGVVFSIAVSAILAKTFIVVVAFKSIKPRSTLQMWIVTRLSITIVCCGSIIQVCICAVWLGTYPPFPDVDMHSEFGHIILCCNEGSTLAFYCVLGYLGFLASLSLLIAFLVRRLPDSFNEAKTITFSMLVFCSVWISFIPTYLSSTGKTMVAVEIFCILASSAGLLGCMFLPKCYVILLRSGDHSRKKVFK

SEQ ID NO: 297 - protein, 973 aa, Oncorhynchus mykiss
MTLKITMPGEQSGSTFSQLRLFLCFLMYCWVLADPVCGYFLNNCTIRGNLSDNFNMKVLCYNRNIEVMPINIPCKVSVLDVAMNNISKIRRLDFKGLSNLKILNMSRNQISQVDNDALLPLKALRELNLAHNRLTTLSDHLFQGLDNLSLLHLDNNLIATISSSSFQPLSSLKTVNLTKNNLHNMKEVQPIVQLPHLQELYIGSNRFTSFQSQEISNMSIELRLLDLSRNPLGVFRITTDVLPYLEVLDIAYCGQLGHMEWDVLDRSFLRNVKSLNLSGIEMSLERMAMVLQTVNSSLVHLRLYDISEERVKALIDFACNIPTLSLLRLHHNNISALSEEFLQSCKQVTEVDLENNNIIQLSEVSFRSMEQLSTLRLGHNRLSSVPDATRNISTLMLLDLSFNIIHKLGCSDFSNLTGLTQLFLFHNQISNLPGCVFQDLKDLRILKLGSNKILTLNDDFMSGLHKLEFLSMSYNKLSSISKGDFKGLASLKTLLLFDNQIASLEDGAFEGLVNLTELRLQSNKITQIDIRNTVLTGLPHLRTLDISCNYITYVNDDKLDPPPLSHLTSLENLLIFSQRHKGLCHLPINFLEGLTSLLSFQAGSLNIKDLHPDTFIHTPQLWFLDMSKNEFTALTPKLFHPTPSLNRLYLPKARLQSLDFLKGANLSRVTFLQVRKNDITAVNETVLQSLPALTYLDMQDNPFTCGCSDAWFVQWMESNNQTQVVGAGEFTCNYPADLKDTKLLDVELQFCTVDLGLYYYISTTCLVLLTLIASFAYHFLKWEVIYGYYLFLAFLYDTKQRNKHKPHGCQYDAFISYNAHDEPWVLRELLPELEGEQGWKLCLHHRDFQPGKPIIDNIMDGIYGSRKTICVISHRYLESEWCSREIQVASFRLFDEQKDVLILVFLEEIPTHQLSPYHRMRKLVKRRSYLSWPRAGEQTGVFWQQLRLALESKDGSAEENPILSGWRLCDSEP

SEQ ID NO: 298 - protein, 792 aa, Rattus norvegicus; identical to SEQ ID NO: 293

SEQ ID NO: 299 - protein, 727 aa, Rattus norvegicus
MGWSLPKEKGLILCLWNKFCRWFHRRESWAQSRDEQNLLQQKRIWESPLLLAAKENNVQALIKLLKFEGCEVHQKGAMGETALHIAALYDNLEAAMVLMEAAPELVFEPMTSELYEGQTALHIAVINQNVNLVRALLARGASVSARATGSVFHYRPHNLIYYGEHPLSFAACVGSEEIVRLLIEHGADIRAQDSLGNTVLHILILQPNKTFACQMYNLLLSYDGGDHLKSLELVPNNQGLTPFKLAGVEGNIVMFQHLMQKRKHIQWTYGPLTSTLYDLTEIDSSGDDQSLLELIVTTKKREARQILDQTPVKELVSLKWKRYGRPYFCVLGAIYVLYIICFTMCCVYRPLKPRITNRTNPRDNTLLQQKLLQEAYVTPKDDLRLVGELVSIVGAVIILLVEIPDIFRLGVTRFFGQTILGGPFHVIIVTYAFMVLVTMVMRLTNSDGEVVPMSFALVLGWCNVMYFARGFQMLGPFTIMIQKMIFGDLMRFCWLMAVVILGFASAFYIIFQTEDPDELGHFYDYPMALFSTFELFLTIIDGPANYDVDLPFMYSITYAAFAIIATLLMLNLLIAMMGDTHWRVAHERDELWRAQVVATTVMLERKLPRCLWPRSGICGREYGLGDRWFLRVEDRQDLNRQRIRRYAQAFQQQDDLYSEDLEKDSGEKLEMARPFGAYLSFPTPSVSRSTSRSSTNWDRLRQGALRKDLQGIINRGLEDGEGWEYQI

SEQ ID NO: 300 - protein, 367 aa, Bos taurus
VICGAVFGCIFGALVIVAVGGFIFWRRRSRKGVKNNDVTFSQIKPKKSKLIKVENFEAYFKKQQADSNCGFAEEYEDLKLVGINLPKYAAELAENRGKNRYNNVLPYDVSRVKLSVQTHSTDDYINANYMPGYHSKEDFIATQGPLPNTLKDFWRMVWEKNVYAVVMLTKCVEQGRTKCEEYWPSKQAQDYGDITVAMTSEIVLPEWTIRDFTVKNTPTSESHPLRQFHFTSWPDHGVPDTTDLLINFRYLVRDYMKQSPPESPILVHCSAGVGRTGTFVAIDRLIYQIENENTVDVYGIVYDLRMHRPLMVQTEDQYVFLNQCVLDIIRSQKDSKVDLIYQNTTAMTIYENLSPITTFGKTNGYIA

SEQ ID NO: 301 - protein, 1141 aa, Gallus gallus
MTLYSCCLILLLFTWNTAAYGPNQRAQKKGDIILGGLFPIHFGVAAKDQDLKSRPESVECIRYNFRGFRWLQAMIFAIEEINNSPNLLPNMTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQQVVEVIQNSTARVIVVFSSGPDLEPLIKEIVRRNITGKIWLASEAWASSSLIAMPEFFRVIGSTIGFALKAGQIPGFREFLQKVHPKKSANNGFAKEFWEETFNCYLPSESKNSPASASFHKAHEEGLGAGNGTAAFRPPCTGDENITSVETPYMDFTHLRISYNVLKHLRHLNFTSNMGEQVDFDEFGDLVGNYSIINWHLSPEDGSVVFEEVGHYNVYAKKGERLFINENKILWSGFSKEVPFSNCSRDCLPGTRKGIIEGEPTCCFECVDCPDGEYSDETGYDCAHVGSLTHSMNVQPAGNAAGHCSSKSLKAWVAILVKEVGTLQVPSMGFDMENLRCASCGDVLFWICVYLLICIFRCSVPFSNCSRDCLPGTRKGIIEGEPTCCFECVDCPDGEYSDETDASACDKCPEDYWSNENHTSCIPKQIEFLSWTEPFGIALTLFAVLGIFLTSFVLGVFTKFRNTPIVKATNRELSYLLLFSLLCCFSSSLFFIGEPQNWTCRLRQPAFGISFVLCISCILVKTNRVLLVFEAKIPTSLHRKWWGLNLQFLLVFLCTFVQIVICVIWLYTAPPSSYRNHELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKVYIILFKPSRNTIEEVRCSTAAHAFKVAARATLRRSNVSRKRSNSLGGSTGSTPSSSISSKSNHEDPFPLPASAERQRQQQRGCKQKVSFGSGTVTLSLSFEEPQKNAMANRNAKRRNSLEAQNSDDSLMRHRALLALQNSESLSAEPGFQTASSPETSSQESVVGDNKEEVPNPEAEPSLPSANSRNFIGTGGSSVTENTVHS

SEQ ID NO: 302 - protein, 349 aa, Xenopus tropicalis
MNASGGGENSTYKCKFDEDFKYVLLPVSYGIVFCVGLILNILALYIFLFRIKPWNASTTYMFNLAISDMMYVISLPLLVYYYSQGDNWPFGVALCKIVKFLFYTNMYCSISFLLCISIHRFLGICYPMKSLGWLKVRNARIISVVVWVIVSACQSPILYFVTTSSNGDSTTCHDTSSVDLFDNFVVYSTVDLALLFCVPFITIIICYCLMARTLMKPSAATAQTSASKKKSIKMIIIVLAVFIICFLPFHINRTLYYYFRKMELDCDILNAINLAYKVTRPLASANSCLDPILYFLAGQTVRRSIIPRNGLSKMKNKFTSYVLENNWSGSATGVSNSEARQSPAVISKV

SEQ ID NO: 303 - protein, 354 aa, Xenopus tropicalis
MAENQDDYYSSDDIFTGLPIIPPGASPCNYEVTSRFNKWFIPATFLLVFLLGLVGNGLVLYVLKSRRCSWHLSDHYLFHLTLSDLFLGLTLPFWATQYAYGWVFGSVPCKLVGALFSINMYSSIFFLACIGLNRYFAIVHAVELHRKQRPIHTFLICAVVWATSCLLSLQEFYFRDVDFIKQLKSHSCHYKFDPETADTWRTTIRLINLSLGFLLPLFLMFFFYCRIFCTLRKSRHGHSYRSQVVIVVLLFVFVLCWGPYNTLLLIDSLQRLDVIAPSCPLFQKLDIGLTVTETLGLSHVCLNPFIYAFVGVKFKSELSRLSKRVSGKVISSGVTGSKEETIVIETNNSYTKVF

SEQ ID NO: 304 - protein, 4082 aa, Gallus gallus
MYRALYSFRSAEPNSLPFAAGETFLLLERSNQHWWLVTRAGSGETGYAPASYLQRLQVLEQDVVLQSIDRAIEAVHNAAMKNGGKYNLEQRDVLQKLIHHRKETVSRKSHSPSPQGMVMTQSSSDHHLDAARQPNGVCRTGYERHHSLPNTEFEEEDEGPYQVGCREYDLYVKKQTAISVIQFQGYCVASARLQHSGQGQGWMQQLFRESDVADYAVWIPPQPRRAAPITPPPPEKRKSAQMAAPLKSKGDFWGEKPLWSCHCEGPGSPAQPSRATVSCSLQALREDIPASAQECVPVGLWGCEQMLGSAEKEELQMCVSQIFPCSRCWLRCAGSATGRGLGRREMLTAACASTGPAGTDAVEIIPGSASSASSVSTTSLDTLYTPSSASDAALPTAASSPATTPPPVPSRSVHTTITRNLDTGPAAHSRYTSSPKDGASKSPQAKRAAPAPPSDVGTPRSHAADGEKTLQGKKAAPAAPANLEAFSNLCLDDKKAAVAEPMPPEPSGLVASVPKTIGAELIELVRRNTHLSYELSRVAIGVVIGHIQTLVPATSGIMEQILISVVESKDLSSGLPSGQICHDEQRLEVIFADLARHKDDAQQRSWALYEDENVICCYLEELLRILTDADPEVCKKMCKKNEFESILSLVAYYQMEHRVPLRLLLLKCFGAMCNLDAAIISTLVNSVLPMELARDMQTHTQDHQKMCYSALVLAMIFSMGEPLPYHHYEHLNSQFVQFLLDVIEDGLPSDTTDQLPDLFINVLLAFNLHIPVPEHSVIMTTISKHSNVKTFTEKLLLLLNRGDDPVCIFKHQPQPPHSVLKFLQDIFASKDTASIFYHTDMMVLIDILVRQIADLSPGDKLRMEYLSLMHAIIRSTPYLQHQHRLSDLQGILQRILGEEEEEQQCQMDKLIILEIYKEFPEISPDLSILLAAAAQNRDPWLLLLGAFGVAVAQTVPRAAIAAACRLRSSTAPGRGAACGQCSVLNACGFLALSFAVALLAALLSGPCCWGSVTADAAVRQPGMQSVREDNASPSAVRPLPYNYQAEVAENQPAGTAVVAVAAQDPDGGEAGRLVYSMDALMNSRSLELFSIDHHAGLITTTQALDRESMELHYFRVTAADHGAPRLSATTMVAITVADRNDHDPVFEQGEYRETIRENVEEGYPILQLRATDVDSPPNANIRYRFVNERAAHAVFEIDPRSGLITTSGPVDREKMERYSLVVEANDQGREPGPRSATVRVYITVLDENDNTPQFSEKRYIVQVREDIRPHTEILRVTATDLDKDNNALVHYNIISGNSRGQFSIDSVTGEIQVVAPLDFEVEREYALRIRAQDAGRPPLSNNTGMASIQVVDINDHAPIFVSTPFQISVLENAPLGHSVIHIQAVDADYGENARLEYKLTGVSADTPFVVNSATGWITVSGPLDRELVEHYFFGVEARDHGSPSLSASASVTITVMDVNDNRPEFTQKEYFIRLNEDAAVGTSVLSVTAIDRDVNSAITYQITGGNTRNRFAISTQGGVGIITLSLPLDYKQERRYVLTVTASDRTLRDNCHVHINITDANTHRPVFQSAHYSVSINEDRPVGSTVVVISATDDDVGENARITYYLEDNVPQFRIDPDSGAITLQAELDYEDQVTYTLAITAKDNGIPQKADTTYVEIMVNDVNDNAPQFVSTHYQGVISEDAPPFTSVLQISATDRDAHTNGRVQYTFQNGEDGDGDFTIEPTSGIIRTVRRLDRENVPVYELTAYAVDRGIPAQRTPVHIQVTIQDVNDNAPVFPAEEFEVLVKENSIVGSVVAQITAIDPDEGPNAQIMYQIVEGNIPEIFQMDIFSGELTALIDLDYETKPEYVIVVQATSAPLVSRATVHIKLIDQNDNSPVLKNFQILFNNYVSNKSNTFPSGVIGKVPAYDPDVSDRLFYTFERGNELHLLIVNQTSGELRLSRKLDNNRPLVASMLVTVTDGIHSVTAQCVLRVIIITEDMLANSITVRLENMWQERFLSPLLATFLEGVATVLATPKEDVFIFNIQNDTDVGGTVLNVSFSALAPRGGHYFSSEELQEQLYMKRMALTGASMLEVLPFDDNVCLREPCQNYMKCISVLKFDSSAPFIASPSTLFRPIHPITGLRCRCPQGFTGDYCETEINLCYSNPCLHGGTCTRKEGGYTCVCRQHFSGENCEVDSRSGRCQPGVCRNGGTCTNGADGGFRCQCPAGGFETPFCELSTRSFPPRSFVMFRGLRQRFHLTLSLSFSTVEPGGLLLYNGRLNERHDFLAVEIIQGQVQLKYSTGESSTVVSPYLPGGVSDGQWHTLQLRYYNKPKVSALGVVQGPSKDKVAILTVDECDASVALQFGSEIGNYSCAAEGVQTSSKKSLDLTGPLLLGGVPNLPENFPVSHRDFVGCMRDLYIDNKRIDLASYIANNGTTAGCHAKHSFCDSSPCKNGGTCSVSWGTYSCLCPVGFGGKDCRHAMHHAHYFQGNSVLSWDFKADMKISVPWYLGLAFRTRQMDGVLLQAHAGQYTTLLCQLSGGLLSFMVSRGSGRSTSLVLDQLQLNDGRWHDLQLELRDVRSGRDSRYVITIMLDFGLYQDTVVVGNELHGLKVKHLHVGGVLGSGEVQNGLRGCIQGVRLGDSVTGTVLPKPSHALRVEAGCSVPSPCDSNPCPANSICKDEWQSYSCVCQPGYYGGECVDACHLNPCKNKSVCRRKPGSPLGYVCECGGNFFGQYCEHRMDQQCPKGWWGNPSCGPCNCDVSKGFDPDCNKTNGQCHCKGWQPLRFCFLCLFLAHLLSVALLAQQGDSRDSRMLADRDLFDESLMSTPERRARHFSAPTRMAPQAPAVPTGCLMAVPISLQDFHYRPKGSDTCLPCDCYPVGSSSRSCNKETGRCHCRPGVIGRQCNSCDSPFAEVTPSGCKVLYDGCPKSLKAGVWWPQTKFGFSAVVLCPKGSLAAECLLNALPGLTAPTHRFPAPSALTALSCLQLHAAPATHCPAAWDLGGTDGAAVRHCDEEKGWLEPDLFNCTSPAFKELSMLLEGLERNETELNTIEAKKLAHRLRAVTDHMDHYFGNDVHITYRLLSRLMAFESRQHGFGLTATQDAHFNECRTACVMELLRYYSGTVAMALNLSFFFPVGVVTSNIRKIDPTGAMRVLVEKPRQWAVCNSLHIHHTVFFPEYCLLFDGHRTNPSGFWTARDCDLVYRNTTHVHCQCSQFGTFGVLMDSSHREQLEGDLETLAIVTYSLVSLSLVALLLTFSFLTCLKGLKSNTRGIHSNISVTLFFSELLFLLGINRTENQFLCTVIAILLHCFFLSTFAWLFVQGLHIYRMQTEARNVNFGAMRFYYAIGWGVPAIITGLAVGLDPEGYGNPDFCWISVHDKLVWSFAGPITVVIVNPFLSLLASAKPGGGQGLGVKGQGGELHVGLVDLESAHALHWGYQAKRRLRRNRFFISATWLFGLLAVNNSVLAFHYLYTVLCSLQGLAVLVLFCVLNEEVQEAWKLACLGKKGQSEEAARSTQGPNTYNNTALFEESGLIRITLGASTISSVSSVRSARTHSSQRGYLRDNMTARQGSALDHSLLGHAGPTDIDVAMFHRDAGGDQDSDSDSDLSLDEERSLSIPSSESEENVRLRGRFPRQFKRAAHSERLLTNPTNTAPKEEFSPSPPAVCPSPDVDGNDLMSYWPALGECEVHPCSLQKWGSERKLGFDINKDAANNNQPDLALTSGDENSLTQTQRQRKGILKNRLQYPPALQGLPAVGRMTNELSWYKTSTLGHRAVPAASYGRIYSGAGSLSQPASRYSSREQLDMLMRRQMSREQLSRNNSGECLETVPSRHGSREELDTIPSRHGSTEHLENLPSRHGSRENLDLLAPRPSQRDHGNTLPRRQGSRDHLETLPCRFGSREQLDCGLVREVSREWLNTLPSRQGSRDRIDRLPSRDTSREQLDLLSRRQPSRDQLASSRQTSREHLDFLSRKSNSREPLGTVPSRQPSQENLGSLSRRQLSRESLEPLSRRQPSRENLEAIPSRHPSTEQLDILSSILASFNTSVLSSVQSSSTPSGPQTTANPSGMHTSTPSAMCPSTPHSSTSHSISELSPDSE

SEQ ID NO: 305 - protein, 2470 aa, Gallus gallus
MARAAFAPLLLVLLCLPLGDGVAAPVSPDEPFFQDLCSYTWEAIDTDKHVLYKINLCFGVEECGRSSAVCAYDVDKRAYMSVGSLTLREISKTLLVFNTTSKCSQQGSEHRIQSNINFLCGKTLGTPEFVTATECVHYFEWRTFVACKKNLFKPVKEVPCYVFDEDLKKHDLSPLIRVPGHYLVDDSDDDSLFINICRDIGRSSGETMNCPAGSAACLIHEGHAYDVGRPQDQLKRHDKDRLILSYERTYNDEKLNFCLGHNPAVTITFVCPSKRGEESAGPKLTAKTNCRYEVEWVTEYACHRDYLESKSCVLTNEQHDVSIDLSPLTLSPDYVTPYLAKDDKEEYYYYLNVCGRTGAGNCEGSMTYTSACQVKSSTNQKKVTGRFENQTLRYSDGDLTLIYPNGDACSSGFQRMTVINFECNETAGNDGRGTPVFTGEVDCTYFFTWYTKYACVKEREDLLCRVADKKKHYDLSPLIRSSESAQNWEAVDSNLSEEWRKRYYINVCHKVLKRGGASGCPDAAAICSVDKKNNSKNLGTFVSPPKKVGENIQLTYSNGGSCGGNKKIKTVITLICRPGDLESAPILISEGVCSFTFDWYTAAACVLSKMEGDNCQVSDPQAGFSFDLSPLTKKNGHYTVNTEEYLFYINVCGSVPNELCHTQSAACQVTQRKDQFWSLGLPNSRLSYYDGLIQLTYKNGTAYNNEKKTQRSTLITFLCDRQAGIGQPEYQVEDNYTYNFRWYTEYACPEMPLECIVTDPNTMDQYDLSSLAKSEKRGENWYAMDNSGPNERKKYYINVCRPLLAVPGCDRRASVCQMEYRHDHDSYYEVTSISNLGVASKELVVERLGHILLTYANGSVCINADGERTSYTTTIHFVCSRGTLNSSPRFISIQECVVTFLWETEAACPIKETKDDSQSCSVRDPNSGFLFNLQPLAAEKGYTTTGIGKTYLLNICEAMPECGKINGKPAAGCEADNLTSVRMVELDKTLYLSSEGFLTLTYRGPLLVESGKSDTFTVTFICNDSYPGELKFVREEINSMLNIHDTFFEFHTALACAPAPVDCQITDAAGNEYDLSDLSKEGKPWVAIDTSKDAKKRTFFLNVCKPLPFVPGCPGGAIGSCVKYADKSKNLGVIQINPQAATDGSLSIIYLNGDMCKDKRRYSTRIIFQCDQTMGSPVLEQEDNCEFVFVWRTLAACPVHKAEGEDCQVKDPRYGHVYNLKPLSSKDIKVSTDEYDYYFRVCGEITEHCRPGAHSVSSCQVKKTDSTFRKVAGLLTEKLTFKNGLIMINYTSGEKCHKIYERSTAILFYCDKTTSEPVFLKETPDCTYMFEWHTQYACPPVKSTECSYRDDEGNFYDFSSLTRHRENWEATDISTSTKIYYINVCKPLVPYGAAHSCPPDAAASLVEGIKCVSLGEVAEGPRWENGISTLKYINGELCPDKIRRKTTILRLKCDESKIESKPELIMAIEDCEYSFLWFTAAACPLKSNVQNDCRVMNPATGHLFDLTSLKRESGYTITDSHNRKIELNVCAEAKSSCANGAAVCITDGPKTLNAGKLSKTLTYEDQVLKLVYEDGDPCPTDLKTKHKSYFSFVCKSDAGDDSQPVFLSFDEQTCTSYFSWHTSLACEEEVSCSVLNGSSVIDLSPLIHRTGYYEAFVDGDQSDVSPDFYINICEPLNPIKDVNCPPGAAVCMVPVNESPIDIGRVTEPPKLNEAVNEVYITYNSTTPCQINNKLNYTSLIVFHCSQGTSLGKPKMIQKLDCSFVFEWETPVVCPDRVKTLGCSVTDEQLHYTFNLTSLSGRSFEVLSGSSRYHVSVCSKAAADVSQGKCKDGAVCMTSGSGVSSFGSIKEMKMNYSRQDETVILQYTGGDRCPPVTEKGELCVFPFKYKGKSYDKCITEEKNRPWCATTVDYQGDGKWGFCVNATARRASTIIFVCDENAGSGSPRLLSDMLGCAVTFEWRTQAVCPPKKMECKFVQKHRTYDLRILSSLTGSWVFYHNGNSYYLNLCQRVYEGPTGCPERASICRKSNNGDVEVLGLVHTQKLNVTGDTVYISYSGGQECGKNKKIMTIIELRCARTVGMPMLQRFDEENCAYFIIWDTRAACAVKPQEVEVVNGTVINPATGKNFSLGDVYNKLYMASGDIRTNGDQYVYEIQLSGITNSSFPECSEANICQVKTSERRFRKIGWAKKAKYYVEDDDLDVIFSSDSRCGKDKSKFVSSSIFFHCSPHVQEGIPEFLHETADCQYLFTWYTSAVCPLISTIAPGIHGGQSDQEAQVYKGLSRRSQAVGAVLSVLLVVLTACLIILLFYKKERRETVVNKITNCCRRTSGVSYKYTKINSEEEANENETEWLMEEIAAPNQRTVKGVQENGHVTTKSVTSDAFTSLHVDDLDSEDEVLTIPDVKIQTGRGLDKSKHPQKKPPRFASDDKAYLLNGGKERKAKAKPGQQQAQNSTNSVSFHDDSDEDLLNV

SEQ ID NO: 306 - protein, 388 aa, Rana pipiens
MDITLNSSLPPADSQLNTTAGALGVNATLSAMRCPFGVLGNMTRLDGNQSFLCNGRDIPPEDTNSIIIAIIITALYSMICVVGLFGNVLVMYVIVRYTKMKTATNIYIFNLALADALATSTLPFQSVNYLMGTWPFGNIVCKIVISIDYYNMFTSIFTLTTMSVDRYIAVCHPVKALDFRTPRNAKIVNVCNWILSSAIGLPVMFMATTKHDRGSTDCALIFPHPSWYWDNLLKICVFIFAFIMPVLIITVCYGMMILRLKSVRMLSGSKEKDRNLRRITRMVLVVVAVFIVCWTPIHIYVIIKALINIPPSLFQTVTWHVCIALGYTNSCLNPVLYAFLDENFKRCFREFCIPTTSTIEQQNSTRLRHNTRDHVSTANTVDRTNHQV

SEQ ID NO: 307 - protein, 788 aa, Homo sapiens
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGALIAILLCIIILLVIVVLFAALKRQRKKEPLILSKEDIRDNIVSYNDEGGGEEDTQAFDIGTLRNPAAIEEKKLRRDIIPETLFIPRRTPTAPDNTDVRDFINERLKEHDLDPTAPPYDSLATYAYEGNDSIAESLSSLESGTTEGDQNYDYLREWGPRFNKLAEMYGGGESDKDS

SEQ ID NO: 308 - protein, 795 aa, Gallus gallus
MAWDMCNQDSVWSDIECAALVGEDQPLCPDLPELDLSELDVNDLDADSFLGGLKWYSDQSEVISSQYSNEPANIFEKIDEENEANLLAVLTETLDSIPVDEDGLPSFDALTDGDVTNEHDASPSPMPDGTPPPQEAEEPSLLKKLLLAPANTQLNYNECSGLSTQNHANTNHRIRTSPVVVKTENSWSNKAKSICQQQKPQRRPCSELLKYLTTNDDPPQTKPAENRNSSKEKCTSKRKPHLQSQTNHLQAKPTSLSLPLTPESPNDPKGSPFENKTIEQTLSVELSGTAGLTPPTTPPHKANQDNPFRTSPKPKSSCKTVAPPSKKPRYSESSGSQGNNPVKKGPEQTELYAQLSKTTALSSGHEERKTKRPSLRLFGDHDYCQSVNSKSEIHIKISQELQDSRQLEFKDSSPGWQCQICSSLEQDQYFKKETLQTSKQGSQGNNRKQLQDQEIRAELNKHFGHPSQAVFDEEADKTGELRDSDYSNEQFSKLPMFINSGLAMDGLFDDSEDESDKLCYPWDGTQSYSLFDVSPSCSSFNSPCRDSVSPPKSLFSQRSQRTRSRSRSFPQRRSCSRSPYSRSRSRSPCSRSSSRSCHCYESSHCRHRAHRSSPSRARSRSRSPYSRRPRYDSYEEYQHERLKREEYRKEYEKRESERAKQRERQRQKAIEERRVIYVGKIRPDTTRKDLRDRFEVFGEIEECTVNLRDDGDSYGFITYRYTCDAFAALENGYTLRRSNEPDFELYFCGRKQFCKSNYADLDSNSDDFDPASTKSKYDSMDFDSLLKEAQRSLRR

SEQ ID NO: 309 - protein, 450 aa, Pseudomonas aeruginosa UCBPP-PA14
MTDLNRTALPSRTDGTVEKTDTLVVGAGQAGVAMSEHLSRLGVPHLVLERNRIAEAWRSGRWDSLVANGPAWHDRFPGMEFDIDPDGFPGKDQVAAYFEAYAKKFDAPIRTGVEVRKVVRNVGRPGFTVETSAGTIEANRVVAATGPFQRPVIPPIAPRDERIRQIHSAHYYNPQQLPEGAVLVVGAGSSGVQIADELQRAGRQVYLSVGAHDRPPRSYRNRDFCWWLGVLGEWDAEVAKPGREHVTIAVSGARGGHTVDFRALAHQGVTLVGLTESFVDGVATFRPDLAENLARGDENYLALLDAADAYIARNGLDLPEEPEARRRLPDPQCVTDPILELDLAEAGVGSIIWATGYAVDFGWLQVDAFDRDGKPRHQRGVSSEPGVYFIGLPWLSRRGSSFIWGVWHDARHVADHIAIQRKYLAYRDAAQRQEQDRASQAPQTSLQEVS

SEQ ID NO: 310 - protein, 235 aa, Mus musculus
MRPVATGIFKALVFIFSSLCAWYSGYLLAELIPDVPLSSTLYNIRSIGERPVLKAPAPKRQKCDHWSPCPPDTYAYRLLSGGGRDKYAKICFEDEVLIGEKTGNVARGINIAVVNYETGKVIATKYFDMYEGDNSGPMAKFIQSTPSKSLLFMVTHDDGSSKLKAQAKDAIEALGSKEIKNMKFRSSWVFVAAKGFELPSEIEREKINHSDQSRNRYAGWPAEIQIEGCIPKGLR

SEQ ID NO: 311 - protein, 382 aa, Xenopus tropicalis
GYSAVYRVCFGTVSFYFLHSVFLLNVKSTQEFRAMIHNGFWFLKLVILVGMCVAAFFIPSDYFIKVWHYVGVCGGFSFVLMQLILITAFAHTWNKNWLTGASKDKRWYLAVVLATLLFYSIASAAFYFLYKFFTHPAGCMLNKGLIGINIVLCIIMSFISVTPCVQIKQPRSGLLQASIISCYVTYLTFSALSSRPPERGESVFGFPAVQYKGDNLTICFPSISRDGLQTEDASIAIIGAAIMYACVLFACNEASYLAEMFGPMWMIKVYTYEFQKASCCFCCPEEEEEEGGGQNSEENKDNSGGQTVIHDESERVVYSYSFFHFVFVLASLYVMMTLTNWFSYENSTLETIFTHGSWPTFWIKVASCWTCVILYLWILLAP

SEQ ID NO: 312 - protein, 69 aa, Xenopus tropicalis
RRRAVSELQLMHNYGEFIHSSQRQEWLQMKLQDMYSASVSTPQESTPKIADHRPPKPQKHKMEENKPKT

SEQ ID NO: 313 - protein, 459 aa, Xenopus tropicalis
IFILVCIISLLGQGYQQCPMSCHVNAKCKIENGAIGCYCSNGYTGDGINFCQDDNECQNATNICGENANCTNIEGSYYCTCAPGFHSSGAERFVTNDGTFCIDECNERNCGYNAECKNTAGGYDCFCKEGYQPSSGRLLFKADDGTYCQENYKLKCHLDDTCISSSINKTISQVTTVKEPISILKEIQRGTARELLPIDVISYVEVLAASTPLLSTVNNSALNKENVTIITFVKTVNNLVEKDKMRVWKNLKDDSRRKSITKLMHTTEQAALDMSQNFKKTTQLNITASDMALKLFAFDSNHMKHTHPHVFIEGDSIKISPKKKESSLSNGTVTIIFLRYENIGVLLGSNDNAGIKEHDSMDQRALVNSPVIAAAINSNPPTLYQLEKITFILKHIEIFSDVGATKCAFWSYTPETMYGEWSTDGCEVLASNVTHTSCRCNHLTHFAILMSSSSRNQVS

SEQ ID NO: 314 - protein, 456 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 315 - protein, 749 aa, Homo sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 316 - protein, 1896 aa, Homo sapiens
MPLPPRSLQVLLLLLLLLLLLPGMWAEAGLPRAGGGSQPPFRTFSGSDWGLTHLLVHEQTGEVYVGAVNRIYKLSGNLTLLRAHVTGPVEDNEKCYPPPSVQSCPHGLGNTDNVNKLLLLDYAANRLLACGSASQGICQSLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFRGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 317 - protein, 1211 aa, Gallus gallus
MSRSNSVTPPGFGGPGLAATEQHRSAWGEASAANGYSYPPPPNRSSGKKASAWRAGGGARKTTSAQASRTRGESGCKMMMSFRSKSAWQEHGDESRRHRSATPRGDSPAAPNNASPREQGEVRPRSVELGLEEKRIKAKIEELDDDGDDGDSEVAFSMGSCCSSLLQIFRSKKFQSEKLERLYQRYFFRLNQSSLTMLMAVLVLVCVVMLIFHATRPLRGVLRRGALPGILLMVVLCMVCNRNDFHQDHMWLACYSVILVILAVQVVGVLLVWPRSRSEGIWWTVFFIYTIYTLLPVRMRAAVISGVVLSAIHLAVSLKINAEDKFLLKQLVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVELGFGGERNAYLKEHSIETFLIVRCSQKRKDEKATIAKMNRQRTNSISHNPPHWGVDRPFYNHLGAHQVSKEMKRMGFEDPKDKNTQESMNPEDEVDEFLGRAIDARSIDRLRSEHVRKFLLTFREPDLEKKYSKQVDDRFGAYVACASLVFLFICFVQIIIVPHSTFMLGFYLTCFLILTTVVFVSIIYSCVKLFPAPLQTLSKKIVQSRTNSTLVGVFAIILVFLSAFVNMFMCSTVDLASCMAAEYNITPDRVDICLISNLTSNYSLGTLQGFCDSPLPNCNFPEYFTYSVLLSLLACSVFLQISCIGKLILMLIIEFIYVLIVEVPGVNLFDNADLLVTANTYMSTNSTLPCSPAMTRVALKIVTPVIITVFVLALYLHAQQVESTARLDFLWKLQATEEKEEMEELQAYNRRLLHNILPKDVAAHFLAQERRNDELYYQSCECVAVMFASISNFSEFYVELEANNEGVECLRLLNEIIADFDEIISEDQFRQLEKIKTIARTYMAASGLNDSTYDKEGKTHIKALADFAMRLMDQMKYINEHSFNNFQMKIGLNIGPVVAGVIGARKPQYDIWNTVNVASRMDSTGVPDRIQVTTDMYQVLAANNYQLEYRGVIKVKGKGEMTTYFLNEGPPIS

SEQ ID NO: 318 - protein, 852 aa, Homo sapiens
MKPMLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLCPFPVDKPNIVVDVIFTNSLPEARRNSRQPLEIRTSKRTELAQGQWVEFGCAPLGPEAYVTVVLKLLGRDSVITSTGPIDLAQKFGYKLVMVPELTCESGVEVTVLPPPCTFVQGVVTVFKEAPRYPGKRTIHLAENSLPLGERRTIFNCTLFDMGKNKYCFDFGISSRSHFSAKEECMLIQRNTETWGLWQPWSQCSATCGDGVRERRRVCLTSFPSSPVCPGMSLEASLCSLEECAAFQPSSPSPLQPQGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 319 - protein, 3458 aa, Homo sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLTRKQNYMMNFSRQHGLRHFYNRRRRSLRRYP

SEQ ID NO: 320 - protein, 830 aa, Roseiflexus sp. RS-1
MRSWKRLSAPVAGVVLITLLTLFAPARSVMMQSSLTFTQTKLLAADAAQYNYFGLSVAVRGDTAIVGAYGKSDLVRNAGAAYAFTRNAGSWTQQARLGTSSPLIDAYLGATVATNGSYTAAGAPYASVGAQNDGVVYLFSNATWQQQTILLPNDPDSLSQFGNALAINDNTLFVGAPMHDSFGVNAGAVYVFTFDGASWVQQQKLIGVDTAPGDRFGSALALNDGWLAVSAPLHSSPGSPGGAVYLFEFDGVSWVQRYKVGAPDTIAGDRFGSAIALDDGWLAVGVPLHRFVGSASGAVYLFEFNGTAWVQRQKFVASDTAGSDQFGSALALENRRLVVGAPLHNSNGPASGAVYIFERATTTWIERAKLIGSDTNAGDRLGGSISIDGNTILVGAYGDTAAGPATGAAYVFVEVTGPGVTTTPSIIVTPTETSTPSATPSNTPSPTFTSTPSATPSNTPSPTFTSTPSPTPSATPTFTSTPSPTPSATPTFTSTPSPTPSATPTFTSTPSPTPSATPTFTSTPSPTPSATPTFTSTPSPTPSATPTFTSTPSPTPSATPTFTSTPSPTPSATPTFTSTPLPTPSATPTFTSTPSPTPSATPTFTSTPSPTPSATPSNTPSATPSNTPTATATVPPGTGTPRPILACVARRSPASYVAIFGYEMEGTAPVHMPVGGENRFNRYREDLGQPTTFEPGTRRAAFAVVFDGLPLTWSLAGRQVTAWANYPIRCSSDAVVRIQPILECTLPDSNGTTIARFGYRNDNAFNVAVPVRWQNFFVPAPIQRGQPVVFAPGRHRFVFETGFSRGALVWFLDGRIAVATNAPVQACQFN

SEQ ID NO: 321 - protein, 420 aa, Xenopus laevis
MMELRVLLLLLLLTLLGAMGSLCLANSDTQAKGAHSNNMTIKTFRIFDDSESEFEEIPWDELDESGEGSGDQAPVSRSARKPIRRNITKEAEQYLSSQWLTKFVPSLYTVVFIVGLPLNLLAIIIFLFKMKVRKPAVVYMLNLAIADVFFVSVLPFKIAYHLSGNDWLFGPGMCRIVTAIFYCNMYCSVLLIASISVDRFLAVVYPMHSLSWRTMSRAYMACSFIWLISIASTIPLLVTEQTQKIPRLDITTCHDVLDLKDLKDFYIYYFSSFCLLFFFVPFIITTICYIGIIRSLSSSSIENSCKKTRALFLAVVVLCVFIICFGPTNVLFLTHYLQEANEFLYFAYILSACVGSVSCCLDPLIYYYASSQCQRYLYSLLCCRKVSEPGSSTGQLMSTAMKNDNCSTNAKSSIYKKLLA

SEQ ID NO: 322 - protein, 462 aa, Mus musculus
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTEKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 323 - protein, 406 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 324 - protein, 365 aa, Canis familiaris
MGDEDYNTSLTYDDEYSDDFDPIMVLDESSPLEGKVARIFLVVVYSIVCFLGILGNGLVIVIATFKMKKTVNAVWFLNLAVADFLFNIFLPIHIAYAAMDYHWVFGTAMCKISNFLLIHNMYTSVFLLTAISFDRCISVLLPVWSQNHRSVRLASVACALIWVLAFFLSSPSLIFRDTALVHEKISCFNNFSLSASGSAPWPAHSRLDPVGFSRHMVVTVTRFLCGFLVPVLIITACYFTIVCKLRRNRLAKTRKPFKVIVTIITTFFLCWCPYHMLYLLELHHAAMPGSVFSLGLPLATAIAIANSCMNPILYVFMGQDFKKFKVALFSRLVNALSEDTVHSSYPSHRSFTKMSSMNDRETSML

SEQ ID NO: 325 - protein, 939 aa, Xenopus tropicalis
MIDLSFLTEAEQEAILRVLNRDAELKKAEEERVRHLYDAVDDENELKYKSGQWFYEAKSKRHRDKIHGADLVRASMRKRKAPPATLAELSRNYKENSKKTWVSSVNKDVFIPPELYGVMEDQEEEQGGFVPVKIEPTQSSKRVSFLSTDKNMESSKNGNVSPSRQRRNPFNSTNEGDDDTELGKDTHEPVNGPESGDKVSYPDVLPPKIKFGVKLPYPAPGEIIRLSSTSPNASLTNGGQIPIPKPRTMPLKKTDSLERSSSDLKREDSFGSSGRPKSILKRRSSSSSTDSESIRLAQKADLNKIGLSTPILQAEPVDESPDKLKQVRFSANVHQNPPSPGGESVGGKEIGEFGILEPGLSQASLENRASSEDSVSAPKPSSSLVLDILTKTIYRKGSGEIPDLNGSPVEGPSLGANSGSLNEDLNNIKEDSFVQENKPEVSLALEANVSSDNDPLYAAVKKPSGSFSSGLSQDKKPESESPDASKRNSIDPKQGIEESDPILRALKRSSTKTLPPLPVQEISLEKSNQDDITVPKEDRDHTYEEVRADKVVPERSHFSDPEKLKRLSQSVPSFLNDDTDGRETDSASESSFQLGRHKKSPSSLTNLSGSSGMASLSSVSGSVMSIYSGDFGNVDIKGNIQFALDYADNLQEFQVFVSQCKDLAAADVKKQRSDPYVKAYLLPEKAKMGKRKTGVKKKTLNPVYNDVLRYKINKNALLSQTLNLSVWHHDVLGRNSFLGEVDVNLASWDWSNKQMNWYPLQPRTPAAGIGLENRGEMKLALKYVPEAFTGAKNAGTGEVHIWLKECTNLPMLRGNKINSFIKCTILPDTSRKSRQKTRAVDKTPNPYFNHTMVYDGFRKEDLKEACVELTVWDHNKLTNHFLGGLRIGLGTGKSYGTPVDWMDSNAAEATTWEKMITSPDTWVEAILPLRMLKMAKMAK

SEQ ID NO: 326 - protein, 1207 aa, Xenopus tropicalis
MDEQVPALCEQLVRAVTVMLEPESRQEYRLEALKFCEEFKERSPLCVPCGLQLSNRSHSPCVRHFGLHVLEHVIKFRWNDMSREEKVCLKDSVMDLISHGMHPILEEESHIKDMMARIVVEMAKREWPQHWPDLLNELDSLTRVGEAQTELVMFILLRLAEDVVTFQNLPTQRRRDIQTTMTQKMDVLFAFMLNILQQSVQQYQHLKTDPANSVKAQGMCRVAVASLKTLAGYIDWVAITHIMADNCKLLGMLCVLLSEPELQLEAAECLLIAVSRKGKLEDRIPLLILFGDEAIEYILSVAQMADTETLEEKRYILLKRICQLICTLGTQICALTQSPDLKVNVPGNFNKYLETLLSFTRHASQFLTSSTILTWGTIFRHEVLSRHPQLLAAIPDFLRSSMVSIVRVGFPSKDNSPSCKYSRMDYESDEDFNGFFNSFRALMGGVVRAACYLDPHTGFCIAKEWLQFQLSAPLDPGPHNAQPGDALCSPTSTSFLQWEAMTFFCECVTSQLFRVVPKEELPVAEGIGLLQQVLSYETMDPLILSFVLTNLSSLMPFITCLSSYVPPVLSKLLDAISFPLSGDMKVSKSRGEMNVRRHANSSLIKVCRDYPELVQPHFEQLHARVTALLGEEQLLTQMGKCALMEALILASNQFKSYDRQQVLLEELIGPLVSGCVSEKTQRAFSGPDEFISFVGADILMHQQEEEDRGAPSRSQLSLCTFALLGMVKRSQWPTDPEEAKAGGFVIGYSASGAPLLRNPGARLLLKVLDSLLALIRTMNNLYLPEVMGKMGDTFCKSLNMLAMDRKLLMGTSQSAIEDCDLPAKTNLSRIQFFFASLFDNCCQILGHCGPSMPHEFYSVPDLASRLLSSVFTNADNVPDYRLRLILRVLVKPLILSCPAEKYESLVCPILGPLIIYLYQRLSQKWLSINQRTVVSEEDYTEEDSECQEVLEEQLVRQLTREVVDLIGSCCIARKSNDFCASGAEVGHSAGQADGDEEEMMTTEAVAPGPIELTELGQFLLANEEISTSLLVISFSPLVWKDTMACQKAASHLCWPLLKQVMSASPLPADAALCVFSNILCGLQTHGQHESCKFPLVQLSFQTYEALRPQYPELRGLMEQVPDVPRDSLEQFDAKLLAPPQKVGEKKRREHFKKLIAGCIGKPLGEQFRKEVHIRNLPALFKKKTKSAPDSDSVLSSCDSSLVALFQP

SEQ ID NO: 327 - protein, 280 aa, Xenopus tropicalis
MTTLTRRGRRADVGQENRVDSEDYIKDKDEEESADSKDIRLTLMEEVLLLGLKDKEGYTSFWNDCISSGLRGGILIELFLRNRVVLEPSTLRKKRLTDRKVLLKSDTPTGDVLLDETLKHMKATEPAETVQSWIELLTGETWNPFKLQYQLRNVRERIAKNLVEKGILTTEKQNFLLFDMTTHPVSNTTEKQRLVKKLQESLLEKWVNDPHRMDRRTLALLVLAHSSDVLENAFSSLSDEKYDMAMTRSKELLDLDPDTEGNKPNTCEMIWAVLSAFNKS

SEQ ID NO: 328 - protein, 356 aa, Canis familiaris
MAAEGWIWRWGWGRRCLGRPGLPGPGPGPATPLFLLLLLGPVVADITDGNSEHLKREHSLIKPYQGVGSSSMPLWDFQGSTILTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEENIDWTKIEPSVNFLKSPKDNVDDPTGNFRSGPLTGWRVFLLLLCALLGIIVCAVVGAVVFQKRQERNKRFY

SEQ ID NO: 329 - protein, 1858 aa, Canis familiaris
MVDKNIYIIQGEINIVVGAIKRNARWSTHTPLDEERDPLLHSFSNLKEVLNNITELSEIEPNVFLRPFLEVIRSEDTTGPITGLALTSVNKFLSYALIDPTHEGTAEGMENMADAVTHARFVGTDPASDEVVLMKILQVLRTLLLTPAGAHLTNESVCEIMQSCFRICFEMRLSELLRKSAEHTLVDMVQLLFTRLPQFKEEPKNYMGTNMKKLKMRAGGMSDSSKWKKQKRSPRPLRHMTKVTSGSELPTSNGTTLSSNLTGGMPFIDVPTPISSASSEAASTVVSPSTDSGLEFSSQTTSKEDLTDLEQPGSPGYSTATEPGSSELGVPEQPDPQQEGVHVEKAQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLLQLLSVERLNLYAASLRVCFLLFESMREHLKFQLEMYIKKLMEIITVENPKMPYEMKEMALEAIVQLWHIPSFVTELYINYDCDYYCSNLFEDLTKLLSKNAFPVSGQLYTTHLLSLDALLTVIDSTEAHCQAKVLNSLTQQEKKEAARSGYEAVDGTRESSNSERAASDGKPVGIAADIPGLHLPGGGRLPAEHGKPGCSDLEEAADSGADKKFTRKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTEHWRNCNGSPFANSDACFALAYAVILLNTDQHNHNVRKQNAPMTLEEFRKNLKGVNGGKDFEQDILEDMYHAIKNEEIVMPEEQTGLVRENYVWNVLLHRGATPEGIFLRVPAGSYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMVEVEDFVDPNGKISLQREETPSNRGESTVLSFVSWLTLSGTEQSSVRGPSTENQEAKRAALDCIKHCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISGQVLLSLRILLLMKPSVLSRVSHQVAYGLHELLKTNAANIHSGDDWATLFTLLECIGSGVKPPAALQATARAEAPDAGAQSDSELPSYHQNDVSLDRGYTSDSEVYADHCRPGKIHRSATDADVVNSGWLVVGKDDIDNSKPGPGPSRLGPSPLVNQYSLTVGLDLGPHDTKSLLKCVESLSFIVRDAAHITPDNFELCVKTLRIFVEASLNGGCKSQEKRGKSHKYDSKGNRFKKKSKEGSVLRRPRTSGQHATRGGHSDDDEDEGVPASYHTVSLQLLDLMHTLHTRAASIYSSWAEEQRHLETGGRKIEADSRTLWAHCWCPLLQGIACLCCDARRQVRMQALTYLQRALLVHDLQKLDALEWESCFNKVLFPLLTKLLENISPADVGGMEETRMRASTLLSKVFLQHLSPLLSLSTFAALWLTILDFMDKYMHAGSSDLLSEAIPESLKNMLLVMDTAEIFHNADARGGSPSALWEITWERIDCFLPHLRDELFKQTVIQDPMPLEPHAQKTLASAHMTPAAGDTRTPGHPPPPEMPSELGACDFEKPEGPRPANSSSPGSPVASSPNRLSPTSDGPPPLAQPPLILQPLASPLQVGVPPMTLPIILNPALIEATSPVPLLATPRPTDPMPTSEVN

SEQ ID NO: 330 - protein, 925 aa, Homo sapiens
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMGCEVLRVLQLSDTAIVPIGYHVPRKAVEFHEDLFPDTAGCVPATDPHGWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGTNGQPWLLSLQPPDMSPVSQAPREAPARRAPSSAQYLEEKSDQQKKEELLNAMVAKLGNREDPLPQDSFEGVDEDEWD

SEQ ID NO: 331 - protein, 2346 aa, Homo sapiens
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGCLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPWKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 332 - protein, 725 aa, Homo sapiens
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLRPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 333 - protein, 4374 aa, Homo sapiens [sequence omitted]

SEQ ID NO: 334 - protein, 578 aa, Macaca mulatta
MTQCLELMQQAAVEVTSPQRDRQVQHTYGQSKGFRAPEAFKDVALQVADAERRRRRRGAQRGAGGSGCCGARGAGGAGVSAADDEVQTLSGSVRRAPTGPPGTPGTPGCAATAKGPGAQQPKPASLGRGRGAAAAILSLGNVLNYLDRYTVAGVLLDIQQHFGVKDRGAGLLQSVFICSFMVAAPIFGYLGDRFNRKVILSCGIFFWSAVTFSSSFIPQQYFWLLVLSRGLVGIGEASYSTIAPTIIGDLFTKNTRTLMLSVFYFAIPLGSGLGYITGSSVKQAAGDWHWALRVSPVLGMITGTLILILVPATKRGHADQLGDQLKTRTSWLRDMKALIRNRSYVFSSLATSAVSFATGALGMWIPLYLHRAQVVQKTAETCNSPPCGAKDSLIFGAITCFTGFLGVVTGAGATRWCRLKTQRADPLVCAVGMLGSAIFICLIFVAAKSSIVGAYICIFVGETLLFSNWAITADILMYVVIPTRRATAVALQSFTSHLLGDAGSPYLIGFISDLIRQSTKDSPLWEFLSLGYALMLCPFVVVLGGMFFLATALFFLSDRAKAEQQVNQLVMPPASVKV

SEQ ID NO: 335 - protein, 1656 aa, Canis familiaris
MDSKKRSSTEAEGSKERGLVHVWQAGSYSVTPERLPGWGGKTVLQAALGVKHGVLLTEDGEVYSFGTLPWRSEPAEICPSCPILENALIGQFVVTVASGSFHNGAVTESGVAYMWGENSAGQCAVANQQYVPEPNPVSISDSETSSLLAVRILQLACGEEHTLALSISREIWAWGTGCQLGLITTTFPVTKPQKVEHLAGRVVLQVACGAFHSLALVQCLPSQDLKPVPERCNQCSQLLITMTDKEDHVIISDSHCCPLGVTLSESQAENQASTAISPSTETLDNQEVFENTLVENELPVATDTNVGNVQTTGGDAISSQQEIMGTTEIPSAQNIPSYPDTQAVNEYMQKLSDHSVRDNSENGKKPMPSQPLVEEAVPNLHSPPTTSTSALNSLVVSCASAVGVRVAATYEAGALSLKKVMNFYSTAPCEPGTQAGSSSIGPEGLKDSREEQVKQESMQGKKSSSLVDIREEESEGGSRRLSLPGLLSQVSPRLLRKAARVKTRTVVLTPTYSGEADALLPSLRTEVWTWGKGKEGQLGHGDVLPRLQPLCVKCLDGKEVIYLEAGGYHSLALTAKSQVYSWGSNTFGQLGHYDFPTTVPRLAKVSSENGVWSVAAGQDYSLFLVDTEDFQPGLYYSGRQDPAEGDNLPENHSGTKTPVLLSCSKLGYISRVTAGKDSYLALVDKNVMGYIASLHELATTERRFYAKLSDIKSQILRPLLSLENLGTASTVQLLQEVASRFSKLCYLIGQHGASLSSFLHGIKEARSLVILKHASLFLDSYTEYCTSITNFLVMGGFQLLAKPAIDFLNKNQELLQDLSEVNDENTQLMEILNTLFFLPIRRLHNYAKVLLKLATCFEVTSPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGTADLPPYGSGSSIQRQEPPISRSAKYTFYKDPRLKDATYDGRWLSGKPHGRGVLKWPDGKMYSGMFRNGLEDGYGEYRIPNKALNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKGTLTMPNGDYIEGYFSGEWGSGIKITGTYFKPSLYESDKDRPKVFRKLGNLAVSADEKWKAVFDECWHQLGCENPGQGEVWKAWDNIAVALTTNRRQHRDSPETLSRSQTQTLESLEFIPQHVGAFSVEKYDDIKKYLIKACDTPLHPLGRLVETLVAVYRMTYVGVGANRRLLQEAVKEIKSYLKRIFQLVRFLFPELPEEGSTIPLSAPLPTERKSFCTGKSDSRSESPEPGYVVTSSGLLLPVLLPRLYPPLFMLYALDNDREEDIYWECVLRLNKQPDIALLGFLGVQRKFWPVTLSILGESKKVLPTTKDACFASAVECLQQISTTFTPSDKLKVIQQTFEEISQSVLASLQEDFLWSMDDLFPVFLYVVLRARIRNLGSEVHLIEDLMDPYLQHGEQGIMFTTLKACYYQIQREKLN

SEQ ID NO: 336 - protein, 237 aa, Mus musculus
MAQPILGHGSLQPASAAGLASLELDSSMDQYVQIRIFKIIVIGDSNVGKTCLTFRFCGGTFPDKTEATIGVDFREKTVEIEGEKIKVQVWDTAGQERFRKSMVEHYYRNVHAVVFVYDVTKMTSFTNLKMWIQECNGHAVPPLVPKVLVGNKCDLREQIQVPSNLALKFADAHNMLLFETSAKDPKESQNVESIFMCLACRLKAQKSLLYRDAERQQGKVQKLEFSQEANGKASCPC

SEQ ID NO: 337 - protein, 523 aa, Homo sapiens [sequence omitted]

SEQ ID NO: 338 - protein, 546 aa, Mus musculus
MCSLGLFPPPPPRGQVTLYEHNNELVTGNSYESPPPDFRGQWINLPVLHLTKDPLKAPGRLDHGTRTAFIHHREQVWKRCINVWHDVGLFGVLNEIANSEEEVFEWVKTACSWALALCGRASSLHGSLFPHLSLRSEDLIAEFAQVTNWSSCCLRVFAWHPHTNKFAVALLDDSIRVYNANSTIVPSLKHRLQRNVAALAWKPLSASVLAVACQSCILIWTLDPTSLSTRPSSGCAQVLSHPGHTPVTSLAWAPNGGWLLSASPVDAVILVWDVSTETCVPLPWFRGGGVTNLLWSPDGSKVLATTPSAVFRVWEAQMWTCEAWPTLSGRCQTGCWSPDGNRLLFTVLGEALIYSLSFPERCGTGKGHVGGAKSATIVADLSETTIQTPDGEERLGGEAHSMVWDPSGERLAVLMKGNPQVQDGNPVILLFRTRNSPVFELLPCGIIQGEPGAQAQLITFHPSFNKGALLSVCWSTGRITHIPLYFVNAQFPRFSPVLGRAQEPPAGGGGSIHEVPLFTETSPTSAPWDPLPGQSSAQPHSPHSHL

SEQ ID NO: 339 - protein, 971 aa, Xenopus tropicalis
MAASLPRTQLPSNNNAVYEKYFHQLESGSSGKVLSSDAAFFLKRSGLADLVLGKIWDLADTDSKGHLNKQEFFVALQLVACAQNGMEVCLSSLKAVVPPPRFDAGSPPLFGTAVTTDIPWAVKPDEKAKYDAIFDSLNPVNGFLSGDKVKPVLLNSKLSVEILGRVWELSDIDHDGLLDRDEFAVAMFLVYSALEKEPVPMSLPHTLVPQSKRKVSISSASLPVIPTLPMPPSKESRQSLPPVGILPTKVQVTQWVVSHAEKTKCDELFHKLDKDMDGLVSGLEVREIFLKTGLPSVLLAHIWTLCDTKDCGKLSKEQFALAFHFINQKIVKGVDPPRVLTPEMMPPSERNAATKVPTASSPVADFSAIKELDSLNNEIVELQREKTSVEQELSEKEDAVKCRTGEVQDLQDEVERETINLQNLKSQKQEVQEILAELDEQKAKLESQLQELRLKCAEETQMIASLKVEITTQETQISNYEDELSKAKSELNRLQEETILLEENLETGKQRLAPLEQQLQESKLEICSVQAKLEELKASENNVEQLNWCHHLVNGIGDHSSLSNSSSEPTNLHENTGCDSPGQLDHQSRSSPVRSSPEINQTSGSDGEEKDDNVNALVPQKEVSFQVDPYDVNPVAPPSAPVQDPGLDFFQSDPFVGSDPFKDDPFGKIDPFGGDPFKDSDPFASDVFFKQASADPFASSKVDSSKEDLFSKSKADSFTSSNADPFVSSKAESLTFQPSSADPFKSSEEDPFTSAKVDPFLATESTFSSEDTLKNNDPFAPGGTVVSAVSESGSEDPFASFFGSESIGTGFADFSLLSKTSTDTFDATLPIKDKESLNKAIFEDDPTQKEEVPPALPPKTGTPTRPCPLPPGKRPSSRTAESSNLFRQGDPFQHFSQSFYKETLSDPFDVNKATSESDNFSTYQSEDDMIEWAKRESEKEEEERLARLKQQEQEDLELAIALSKSEISEAN

SEQ ID NO: 340 - protein, 4665 aa, Xenopus tropicalis
MTQERDVIQVIMSANSPSGPPIRGSSNPAPNEKAKSTSKKRKACHACDNPRIEGKKLCQDCFNQLGSSENTPSTSSGQVNELITWIKKAVSSSLEPASTSQGHGQEFLSEVSEEEEDFPDPELELSGSDEDPTCESGFDLTLMLWIWLPRKLMSLKLIKCMGKDQKDNTLFLSMRQIVLEELEGMQELKGHLHGRISGPPPCMREETGSSDMMEEEVRIQQAELVFAETVDSDIMMQGSNRDLLYLFRNLERKMKREHHYGKRLHDKKQYKKAPRPILKSGKSVQFAKYGDVSHGSQDLHSFLPSSSSLLVSDPEVSESDRNDVRVRLKGMRNRRFISTPRRDPIRTQSSRNVRGEEEGDLGPDSPHPICLPLQCGPSHSYQMMLPESIAIVCSLKFQELCTSQSIKTCVRPRTVRVPQYKDVRACVRAQQMPWLQQKKHIPDFSGFCNSGKIVSFMVTTGDQKVTIQSNMDEKANMDQEDLSSPVPEEEVEADAQSSVLKADAEQSISPPLISMNKAPPTLWIRRGRPSSSSRTIFLPTPDAEPKGQRRRGAAKRPSIVPGSANTVSSPTVVAPPAGKKNSVFSNEVRKVMAKQAKVAKDERRAQLDARHKYLISKLADGIGIGENEVEEFLISDDKFKLIADFFAPNGSKKLIFFYQEVVQTCKPNIPMWADGANLNASYTNLQKKLFITVGSSEGLTGTCLFFLRTTEKAITTANISQNWGVVTDGMQNLQIQEYLDSLDKFIGTLSSARHNLEGKIELKRVDSGNFLENMHNPSDFINAGGNSEIIEKLEAMLSIWIKQIEQVLAESEQMRKEADDIGPSAELEHWKSRMSSFNSLLDEIKSPKVKKVLSILQAAKSRILKKWKELDCNVTNAANEAKDNVKYLYTLDKFFGPLGKASPATMVEHIPSLMNSIRMIYSTSQYYNTSEHMTSLFLKVTNQTVSTCKSYLSHGVIKIWDLDSENYIFGKLDTFCKRLEKISDISNNLESLADLQTIKIEGVEKISIRYETIVTNTKSKSYDVLDHRKQETEQMINLLKKFERIGKDHLDFGEKYMIVLQRYSRDLDMVRKLYQKQKENPPTPRNTPPITGKIMWARQLFRKIDQPMKFLKTKPELLKGLEMKKIIRHYNKMASVLMEFELLYHRGWCKCADIAKNGLHASLLVRHPNTKELYVNLDPMVMEVLHETKYLQKMGFEVPDVILSMATRGDHIKAQQIKLQDMLMVYQTFCIGIPSLLKPLMLPFIGQIEEVLSPGLTQLTWTSLNTDKFIAKVYSSLTEVQQIYKEASDTLEFRIEKMLQDIAQTPLVDLPEEDAISVPDFLERTEKVMNNGNNMHNLPSILFSRQSKQVELCLYEMIDALKNRLKPTDRNSLQDSFACAHLDTKQKTRCQECLSCSYYNVIGHLCQKNTDSLVKCTKVSLDAIKRRLHTISSVYQTAKLTKDHTPTPLFKAEIHLAIPNVVMKPSLEDIQSAVNKATNIILSAAKDIPLWKFAYLHHKQQQLEQNAARDLGDELTKMVVLKPLDKQISEHKDVTKVIIQLSTIVLSLKAEAANVLNSFTKFSGIWNQDVEEKVKEFLDTNPVMSEFRSQLSYYSQLETQISELPAHCIVGSVDFTTDSLKMALVQECRHWKRVFGSALNKKAAMDMDEIYLFIDNLSKRLSRPVLDLDDVRGAMDALKEIRDAEIRIDMMIGPIEESNSLLLKYELVFQDGNAERVDGLAYAWKNLNTQAVYTQNLLIKVQPEMKTDLLDGVEKFHIDAAEFYKNYELLIRKLPKALKEWQAFNDLKKKIDDFSESCPLLEMMANKAMMNRHWERISQLTGHKFDVESESFSLKNIMEASLLKYKEDIEDICISAVKEKDIEAKLKSVISEWSAHCFTFTQFKSRGELLLKGSDTSEKIALMEDSLMILGSIMSNRYNAPFKPTIQQWVQKLSNTTEIIENWLTVQNLWIYLEAVFVGGDIAKQLPQEAKRFQNIDKSWQKIMQRAHETPNIVQCCVGDETLAQLLPHLLEQLEMCQKSLTGYLEKKRLVFPRFFFVSDPALLEILGQASDSHTIQAHLLSLFDNVNRVGFHEKNYDQILYFESQEGEKVNLIEPVNAQGNVEVWLGLLLNGVKKTLHTIIRQASIAISDSGFKLYDFQTMYPAQIGLLGIQMIWTRDAEEALNMAKTDRKVMQTTNQKFLDLLNDLIDMTTRDLTRMERTKYETLITIHVHQKDIFDDLVRMNIKSASDFEWQKQSRFYFIEDIDKCIIQITDVEFSYCNEYLGCTDRLVITPLTDRYSLAQSGAWGCFDEFNRIELPVLSVAAQQIYIVLQCKKSKKSQFIFTDGDVVDMDREFGIFLTMNPGYAGRQELPENLKVQFRTVAMMVPDRAIIMRVKLASAGFRDNQILSRKFYTLYKLCEEQLSKQVHYDFGLRNILSVLRTLGAVKRSNPDEPEKTVVMRVLRDMNLSKLVDEDEPLFMSLINDLFPGITLDKAGYPDLEAAIQKQTEEAGLIHHPPWILKLIQLYETQRVRHGMMTLGPSGAGKTKCINILMKAMTDCGAPHKEMRMNPKAITASQMFGTLDVATNDWTDGIFSTLWRKTLKAKKGEHIWIVLDGPVDAIWIENLNSVLDDNKTLTLANGDRIPMAPNCKIVFEPHNIDNASPATVSRNGMVFMSSSVLDWRPMLKAWLQTLPAFQHEILWNCFNSIFQDLLNFIFTAVSPKMQILECMYIKQAIDLLQGLLSDKDEKQPSQEHVARLFIFAVMWSIGALLELDDRMKMETFLQDHSAPLELPTVSGDQTIFEFVIDENGQWQHWSKKVPEYVYPKDSVPEYASILVPNVDNVRTDFLMHTIMKQGKAVLLIGEQGTAKTVMIKGYTSKYDPEYHATKSLNFSSATLPNMFQRSIESYIDKRMGTTYGPPAGKKMTVFIDDINMPVINEWGDQITNEIVRQLMEQKGFYNLEKPGEFTSVVDIQFVAAMIHPGGGRNDIPQRLKRQFTVFNCTLPSNSSIDKIFRTVAEGYFCEQRGFSTGVCKLASALVPTTRKIWQATKIKMLPTPAKFHYIFNLRDLSRIWQGILIIMSEVCQSTDILVALFKHECSRVISDRFIDQKDKDWFENTVHKIAVEDHGQEIMNNALKESYFVDFLRDAPEATGDEPEDADLEAPKVYEPIPSFEQLADRLDLYMQQYNEAVRGSRMDLVFFKDAMIHLVKISRIIRTPQGNALLVGVGGSGKQSLTRLASYIAGYQSFQITLTRTYGTNNLMDDLKILYRTAGQKGCGITFIFTDNEIKDESFLEYMNNVLASGEVSNLFARDEIDEITQDLIPVMKKEHPRRAPTAENLYDYFLSRVRRNLHVVLCFSPVGEKFRTRALKFPGLISGCTMDWFQRWPRDALVAVAQHFLSSYKIECTEEVKQSVVNTMGTFQDIVAEKCVEYFERYRRQTYVTPKSYLSFIGGYKTIYGEKIEYVGNLSNRMKTGLAKLMEAEVSVNQLSKELAVKEKDLAVASKKADEVLQEVTFKAHAAEKVKMQVQKVKDKAQAIVDEIAIDKAAAEEKLEVARPALQEAEAALEDSITEEIVELLQPYLDMEDYNLESAKKVCGNVAGLCSWTQAMAYFFGINKEVLPLKANLALQGAKLAVAQQELNNAQSQLDAKQRELDDVQAMYDAAMREKQALLDDAEACRRKMINATALIEGLGGEKIRWTESSKNFQNQITRLVGDVLLATGFLSYSGPFNQEYRNLLLQLWKKEMNSRKIPHSEDLNLISMLVDNATIGEWNLQGLPNDDLSIQNGIIVTKASRFPLLIDPQGQGKIWIKNREKNNELQVTSLNHKYFRTHLEDCLSLGRPLLIEDVGEELDPALDNVLEKNFIKSGSTFKVKVGDKEVDVMKGFALYITTKLANPAYTPEISAKTAVIDFTVTMKGLEDQLLGRVILTEKQELEAERVKLMEEVTTNKRKMQELEDNLLFRLTSTQGSLVDDESLIEVLRITKSTAEEVSEKLTVAAETEVKINTAREEYRPVATRGSILYFLIVEMSLVNVMYQTSLRQFLGIFDISMDRSTKSQITSKRITNIIEYLTFEVFKYTARGLYEDHKFLFTLLMALKIDLQAKKISHNEFQTLIKGGATLDLNSVEPKPKKWILDMTWLNLVQLSNLTPFNNLLGQVARNEKNWKAWFDVEAPEEAPLPDGYDNVLDTFRRLLLIRSWCPDRTIAQARHYIAESLGVKYAEGFILDMEAMWAESDCRTPLVCFLSMGSDPTENIERLSKSKMVPLDLLVILLPLILYHAHIISITIEAEVLNQCAVLQNAPCRAISMGQGQEVHARRLLNQSMQDGGWLLLQNCHLGLDFMDELLDTVTVTETVHDGFRTWITTEVHPKFPINLLQSSVKFTNEPPQGVKAGLKRTYSGISQELLDVTNLPQWKPLLYGVAFLHTTVQERRKFGPLGWNIPYEFNQADFAASIQFVQNHLDEMDTKRGVNWSCLRYMLGEVQYGGRVTDDMDKTLLNTFARVWFGENMFSDKFCFYKGYGIPKGKTIDEYLQYIDQLPLVDTPEVFGLHGNADITYQTNMANETLSTIVNIQPKDSGGGAGETRESVVQRLANEMLEKLPEDYIPHEVKARLQKMGPIQPMNIFLRQEIDRMQRVIARVRSTLIDLKLAIDGTIPDESESENIKNITNKRLTKFKSV

SEQ ID NO: 341 - protein, 348 aa, Xenopus tropicalis
MAAELTSRFRRIRSMGELRARRRGVTFSHTLIALFALSEDTENIWKQQIILRLLQLIEIPMLEDIFESPVQTEQKKHFSDLIVSNTFLDREILQTLNLPKLDRWLITAVECLEYFPDQQIVMLAQQLPHTSNLNEDLDLCKKMLFDLIAKYYTQEREAFLNSLHLNCLMGIIELLECGKQTQALEAVQLYLRLLVPKAKEELRRLLTFMAVASEIDSYKVHKQFDNKMVFVRTFTKVLIRSTTIPKQQCEDFTVFLLENYTEIFKTPIVLLDLVSTKLRSLQNGMDPDTISGFTFCDRWTPEEYDNLRHHYTTCELQQLKEEIERNSAIPEKKKKKILKEFDKYHPFD

SEQ ID NO: 342 - protein, 2436 aa, Homo sapiens
MGFLHQLQLLLWKNVTLKRRSPWVLAFEIFIPLVLFFILLGLRQKKPTISVKEVPFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 343 - protein, 1150 aa, Bos taurus
MKLKKQVTVCGAAIFCVAVFSLYLMLDRVQHDPARHQNGGNFPRSQISVLQNRIEQLEQLLEENHEIISHIKDSVLELTANVEGPPALLPYYVANGSWVVPPEPRPSFFSISPQDCQFALGGRGPKPELQMLTISEELPFDNVDGGVWKQGFDISYSPHDWDSEDLQVFVVPHSHNDPGWLKTFDKYYTEQTQHILNNMVSKLQEDPRRRFIWAEVSFFAKWWDNISAQKRAAVRRLVGNGQLEIATGGWVMPDEANSHYFALIDQLIEGHQWLEKNLGATPRSGWAVDPFGYSPTMPYLLRRANLTSMLIQRVHYAIKKHFAASHSLEFMWRQTWDSDASTDIFCHMMPFYSYDVPHTCGPDPKICCQFDFKRLPGGRISCPWKVPPRAITEANVAERAGLLLDQYRKKSRLFRSNVLLVPLGDDFRYDKPQEWDAQFFNYQRLFDFLNSKPDLHVQAQFGTLSDYFDALYKRTGVEPGARPPGFPVLSGDFFSYADREDHYWTGYYTSRPFYKNLDRVLEAHLRGAEILYSLAVAHARRAGLASQFPLSNFALLTDARRTLGLFQHHDAITGTAKEAVVVDYGVRLLRSLVSLKQVIMNAAHYLVLGDKKTYHFDPEVPFLQMDDTRLNHDALPERTVIQLESSPRYVVLFNPLEQERLSVVSLLVSSPRVRVLSEEGQPLAVQVSAHWSSATDMVPDVYQVSVPVRLPALGLGVLQLQQGLDGPRTLPSSVRVYLHGRPLSVSRNEAFPLRVIDSGTSDFALSNRYMQVWFSGLTGLLKSVRRVDEEQEQRVDMEFLVYGTRSSKDKSGAYLFLPDGEAKPYVPRDPPVLRVTEGPFFSEVVACYEHVHQVVRLYNLPGVEGLSLDVSSLVDIRDYVNKELALRIRTDINSQGIFFTDLNGFQVQPRRYLKKLPLQANFYPMPVMAYLQDAQNRLTLHTAQALGVSSLHDGQLEVILDRRLMQDDNRGLGQGLKDNKRTCNHFRLLLERRTPGREVREAASASFPSLLSHLTSMYLNTPVLALPVARRQAPGPALRSFHPLASSLPCDFHLLNLRTLQAEEDGLPSAETALLLHRKGFDCGLEAKNLGFNCTTSQGKVALGSLFHGLDVVFLQPTSLTLLYPLASPSNSTDVYVEPMEITTFRLRLG

SEQ ID NO: 344 - protein, 825 aa, Canis familiaris
MMQNVHLAPETDEDDLYSGYNDYNPTYDTEELENDTAFQQAVRTSHGRRPPITAKIPSTAVTRPVATGYGSKTSLASSMGRPMTGAIQDGVTRPMTAVRAAGFTKAALRGSAFDPLGQSRGPAPPLEAKNEDSPEEKIRQLEKKVNELVEESCIANSCGDLKLALEKAKDAGRKERILVRQREQVTTPENINLDLTYSVLLNLASQYSANEMYAEALTTFQVIVKNKMFSNAGRLKVNMGNIYLKQRNYSKAIKFYRMALDQIPSVHKEMRIKIMQNIGVTFIKTGQYSDAINSFEHIMSMAPNLKAGFNLILSYFAVGDRDKMKKAFQKLIAVPLEIDEDDKYISPSDDPHTNLVIEAIKNDRLRQMERERKAMAEKYIMTAAKLIAPVIETSFAVGYDWCVEVVKASQYVELANDLEINKAITYLRQKDFNQAVETLKMFEKKDSRVKSAAATNLSFLYYLENEFAQASSYADLAVNSDRYNPSALTNKGNTVFANGDYEKAAEFYKEALRNDSSCTEALYNIGLTYKRLNRLDEALDCFLKLHTILRNSAQVLYQIANVYELMEDPHQAIEWLMQLISVVPTDSRALSKLGELYDSEGDKSQAFQYYYESYRYFPSNIEVIEWLGAYYIDTQFCEKAIQYFERASLIQPVSLKWKLMVASCFRRSGNYQKALDTYKDIHRKFPENVECLRFLVRLCTDIGLKEVQEYATKLKRLEKMKEIREQRIKSGRDGSGGPRSRREGSASSDSGQNCSASSKGERLSAKLRALPGTNEPYESSSNKEIDASYVDPLGPQIERPKTAAKKRIDEDDFADEELGDDLLPE

SEQ ID NO: 345 - protein, 154 aa, Homo sapiens
MGKSASKQFHNEVLKAHNEYRQKHGVPPLKLCKNLNREAQQYSEALASTRILKHSPESSRGQCGENLAWASYDQTGKEVADRWYSEIKNYNFQQPGFTSGTGHFTAMVWKNTKKMGVGKASASDGSSFVVARYFPAGNVVNEGFFEENVLPPKK

SEQ ID NO: 346 - protein, 1143 aa, Homo sapiens
MKLSRQFTVFGSAIFCVVIFSLYLMLDRGHLDYPRNPRREGSFPQGQLSMLQEKIDHLERLLAENNEIISNIRDSVINLSESVEDGPKSSQSNFSQGAGSHLLPSQLSLSVDTADCLFASQSGSHNSDVQMLDVYSLISFDNPDGGVWKQGFDITYESNEWDTEPLQVFVVPHSHNDPGWLKTFNDYFRDKTQYIFNNMVLKLKEDSRRKFIWSEISYLSKWWDIIDIQKKDAVKSLIENGQLEIVTGGWVMPDEATPHYFALIDQLIEGHQWLENNIGVKPRSGWAIDPFGHSPTMAYLLNRAGLSHMLIQRVHYAVKKHFALHKTLEFFWRQNWDLGSVTDILCHMMPFYSYDIPHTCGPDPKICCQFDFKRLPGGRFGCPWGVPPETIHPGNVQSRARMLLDQYRKKSKLFRTKVLLAPLGDDFRYCEYTEWDLQFKNYQQLFDYMNSQSKFKVKIQFGTLSDFFDALDKADETQRDKGQSMFPVLSGDFFTYADRDDHYWSGYFTSRPFYKRMDRIMESHLRAAEILYYFALRQAHKYKINKFLSSSLYTALTEARRNLGLFQHHDAITGTAKDWVVVDYGTRLFHSLMVLEKIIGNSAFLLILKDKLTYDSYSPDTFLEMDLKQKSQDSLPQKNIIRLSAEPRYLVVYNPLEQDRISLVSVYVSSPTVQVFSASGKPVEVQVSAVWDTANTISETAYEISFRAHIPPLGLKVYKILESASSNSHLADYVLYKNKVEDSGIFTIKNMINTEEGITLENSFVLLRFDQTGLMKQMMTKEDGKHHEVNVQFSWYGTTIKRDKSGAYLFLPDGNAKPYVYTTPPFVRVTHGRIYSEVTCFFDHVTHRVRLYHIQGIEGQSVEVSNIVDIRKVYNREIAMKISSDIKSQNRFYTDLNGYQIQPRMTLSKLPLQANVYPMTTMAYIQDAKHRLTLLSAQSLGVSSLNSGQIEVIMDRRLMQDDNRGLEQGIQDNKITANLFRILLEKRSAVNTEEEKKSVSYPSLLSHITSSLMNHPVIPMANKFSPTLELQGEFSPLQSSLPCDIHLVNLRTIQSKVGNGHSNEAALILHRKGFDCRFSSKGTGLFCSTTQGKILVQKLLNKFIVESLTPSSLSLMHSPPGTQNISEINLSPMEISTFRIQLR

SEQ ID NO: 347 - protein, 556 aa, Xenopus tropicalis
PQKNAEILSSQYGFNIFLAGLLLMFAWAIHAVGITDRDLLSYLITLMLIQMIWMLWYIFRSQSIRRSIIEKDTDAGARWLRCGITLFAVITLILDSFKIGYYIGYSECLSITEGIFPVTHTIHTLLQVYFLWFHAKDIIQSFKTLERFGLIHAVFTNLLLWANGILTESKHELNEHKERLITLGFSNITMDHHTPECNCTSSVCSIFSQGIYYLYPFTIEYHILASTMLYVLWKNIGRTVKHHQQQKIHFKFHGITIGTILGLIVLTTTVAVLVVYLIQIGRSKSKSELALNMFYLYAITVLTLMCTSAIIGLIIYRIENKSLDDSESPAKKLDSDLLVGSACGSWLISWGSILAIICAETHPDYTWYNLPYSILVIIEKYIQNLFIIECIHRKEEEPTDDHSVERIFSVSARSTISLASSSYDVFSDSVTICNKEFPYISNSEVPIGEDCAEEQRNQDNNNSIRLTPCKVSIHATRPAKLNKKRRVLKNIAAFLFLCNISLWIPPAFGCRPQYDNGLEEIVFGFEPWITVVNLAMPFSIFYRMHSASSLFEVYCK

SEQ ID NO: 348 - protein, 715 aa, Homo sapiens
MARELYHEEFARAGKQAGLQVWRIEKLELVPVPQSAHGDFYVGDAYLVLHTAKTSRGFTYHLHFWLGKECSQDESTAAAIFTVQMDDYLGGKPVQNRELQGYESNDFVSYFKGGLKYKAGGVASGLNHVLTNDLTAKRLLHVKGRRVVRATEVPLSWDSFNKGDCFIIDLGTEIYQWCGSSCNKYERLKANQVATGIRYNERKGRSELIVVEEGSEPSELIKVLGEKPELPDGGDDDDIIADISNRKMAKLYMVSDASGSMRVTVVAEENPFSMAMLLSEECFILDHGAAKQIFVWKGKDANPQERKAAMKTAEEFLQQMNYSKNTQIQVLPEGGETPIFKQFFKDWRDKDQSDGFGKVYVTEKVAQIKQIPFDASKLHSSPQMAAQHNMVDDGSGKVEIWRVENNGRIQVDQNSYGEFYGGDCYIILYTYPRGQIIYTWQGANATRDELTTSAFLTVQLDRSLGGQAVQIRVSQGKEPVHLLSLFKDKPLIIYKNGTSKKGGQAPAPPTRLFQVRRNLASITRIVEVDVDANSLNSNDVFVLKLPQNSGYIWVGKGASQEEEKGAEYVASVLKCKTLRIQEGEEPEEFWNSLGGKKDYQTSPLLETQAEDHPPRLYGCSNKTGRFVIEEIPGEFTQDDLAEDDVMLLDAWEQIFIWIGKDANEVEKKESLKSAKMYLETDPSGRDKRTPIVIIKQGHEPPTFTGWFLGWDSSKW

SEQ ID NO: 349 - protein, 928 aa, Homo sapiens
PPPGSHVTAPPPSARPARPPRVRGPAAAPGRRGSGGAGAMAERGRLGLPGAPGALNTPVPMNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 350 - protein, 473 aa, Danio rerio
MQSSLLSVAHSPGIPTAVSLMWKSGNHQSSNWSGMERENATSLADLDTFENRRAQYGQFSPSTSIFLTVLMTLLVFATVLGNALVILAFVVEKSLRTQGNFFFLNLAIADFLVGGFCIPVYIPYVLTGEWRLGRGLCKLWLVVDYMLCTASVFNIVLISFDRFQSVTKAVSYRCQKGITKDAVLKMLCVWLAAFLLYGPAIISWEHITGGSVVPDGECYAEFYFNWYFLMTASTVEFFTPFISVTYFNLSIYINIRNRCAMREEQPTYVRLRSFKMKPLGAGDVQRVFFVRPVEESRVADLASRSRCCRLASTAKVSAAEFGNGRQSKRRDSTLADLPPLQVEERILAASEAQFHYVDHSAGPHRHRPDMVASLANRFRLSRDKKVAKSLAVIVCVFGLCWAPYTLLMIIRAACHGQCVQHYLYEISFWLLWINSSINPILYPLCHSSFKRAFSKLLCPSKTKIQPQNIDQKY

SEQ ID NO: 351 - protein, 899 aa, Xenopus tropicalis
MSARHLTSSQVITLPSAPLHILHLTSPQPSGNHTAFCSTSYTPSYQPSGNHTAFCSTSYTPFTSPQVITLPSAPLHILHLASSQGGCQRFFRIATNIRHVCGMLLTLKRYIGRNKVVEWALFHLQMQIHSRSDLLFNISSFSKNNTRKDFEKLKNLLCVHPQHRTQQVLRQCHYPPSYYVYRRILSKASRPKQITLSICIQSCLKKNRAFQSLRDKTQLQLCQHAVYQEYEAKTLVIRQGHKPIECYLILSGTLMAVTENGNAKKQSALTDELYEVEEGDFVGEIGLVTNKRPTSFICKTHVEVLVIDKEAFKDVLAAKECSIVFIVAFRENRPPCSLLLTKKLQSWNNSNCKQPDFWLFGPDKVWLALPRAPFSASYRATSNQVHTRARPQTAGPLTFSLQERTERCDLDYKDKKQTEEDGCTLQHATASPAGRFITVGTLEHGGVFGLAETIFMSSGLRFSLISEGAECILIPTKLFLLEAPAKSKQIAQELQLSGPHNDDGLWVSHKGLGLGKNIATIDCFVPSSILSSCHSDCHPLVLEKKTLHCIYDKRSNDIQANVPQRRSQLHMTSENQSDVLAFPPVIAFVASGKCREHNRALFTSDFSNLTHSSTKEVSTGWKKGGQIMAAASGHSSPWNTAETATQLDSFACNNRPFTQHLSCQIRVRLGHRDTGKKPSAQAQTSVPITTPPAAGVLPDAFHLHVFRGGCQAGGGGPEEGFPLSSNALQEQELQLWNELGNDCSTILSDSLGPSTLEELCFMIMGILQKSQRKSNVSVLIRTFILDKGPNEDLTKDALPEMPFWQGSDEKEESKRFLFHYSKSHESGNSDITSQEFIVDHVSVFMSSQSSVLHPLLQLVPQLHDRRMKRFKAEEEVQGPGLSRGYFLFRVRHLFSPVCK

SEQ ID NO: 352 - protein, 1397 aa, Xenopus tropicalis
MGTKDVSLLEESSAQHSDLHVQEPSTPVDIPAPPPPPPPNLNNCMIPGSPILRFDTKQRSRLRNFNWEAIPPEKVKGKPSLWSSELFHEDLQIDTRRMEELFGKPEEDKKRNSLLVRRTMSLGDSHLNKVFLLDSRRSMNISIFLKQFKRSAAQIVEDIRKGKAEEYSSEKLSELLKQLPERDEIKRLQAFKGDRSRLSEADLFMLLLLELPSYTLRLEALILKKDFHANLVSQLSTARELKGAAEELLQCSELHAILKLVLKAGNFMNAGGYAGNAMGFRISSLLKLAETKANKPGMNLLHFVVMEVQSKNAGLLSFTDRLEHVSSASRLSEVGLLEEFNKLQSRVTSMRQALKASEQKDLREQMGKFIEYTEDQLLEVQKEIKALQKARQQLVEFLCEEEETFCLEECCKVFSCFCQKFQLAIKENQDREREDKRRLQWEKERLQKRHSMATYSSSENRTVEDDLELTLERNLRSLTRSPSLRFCRMRSSGSFSPTSTIPELIQRDKSEEDWDQKNANQMREVSERLLKQQMEYKKSKNVHILSTTIYMNTETTHQASATSQPPSIGKSGHTSSPLSEEPVFEIPKQSIDHHGLQRQAASLPIATADTSGESQPESDKDTQCVTQPELKPANRLQPQPLVSSPNVILPQYELESANQPNSQITHEATKHSDLVLPLPSATYMPEINMLGTVGKLRDQDISGVSQTQPETGNLRQSQPKSDTNVLLINGPEYEKPNQTKIQNSQDDSRQLCLETENIRESLPGSPRESIKQSSAQIVPSAQGPEESHLESTSEACRQCPTKTDPTIVSQANCESPNEVKRQPLTQSGSLNKRPLLLQNVMDTSTSLKFKPVPANRRRSLPQSATEPPRLPVSRRQSVPQCATERTSPLTIAPEPTLVSQPEPNISSQSQHEKKTDSLKQMPSQSGSRVKSKPVVHPVMQQNSLDQTKPEVIVESLSQSESRCPEPSCKQSELEAQGQSAAHAELEPAEDPIQPGNETPKQLLVQPLTRNVKQTQCQPVAKVLKQLVGKQRMSKQLQAQPGVQKSQPAAETVNHSVARSKPESIKYTLIRTSSVNTRTTVMESLPNKQQGKPTKAQPSTTQEKMTEIQDETSKTVKPRDSESKPLAKGQKPIHTVGKRDPPNPCSKWKRELHNTPDRGGSGGKGDLKSESSSAATVSNSVEHKREDNQKNVSMGRSGSPIAKILKSSDPGLGNKKVFAQKDAAPTPLQGPGGMKQTTSSPKLAQKETRDIKVPSRTSSPNPGSVKMTPDKVAWNAKEKNDTAHVYSNEGSKVAERKYRSFLTSKSYIPAPQKSLQLPWHNLESTRESVWVPHVGPSRTNAVARMAFRVIRQEFSTSIHRGLRSQHLDNLPVWRPRALSHLLKHNALANMAHQRMKHA

SEQ ID NO: 353 - protein, 1140 aa, Danio rerio
MPSTCETIRLMNGKNSCSGRVEVFFYDQYKNAQWGTVCDDGWSLSDAAVVCREMGCGDAIEANSNAFFGEGVGIVYLSSVTCSGNEATLSNCGSKTMGEFYCAHSRDAGVVCNSLVRLANGTNPCSGRVEVLNDGQWGTVCSDGWDLSDAAVICKEMGCGSVSGSKTGAYFGQGSGPVWLSDVQCSNSESTLRQCVLNGWGQNSCGHEKDAGVACQSKLRLANNWNSCSGRVEIYYNQWGYSQWGSVCDNGWNLPDAAVLCRDVGCGDAVAAKGAAYFGPGGGPVWLDNMNCTGNESTITACKFDRVGQYSLSHLKDAAVICQFLVRLVNGPNSCSGRVEVFFDGQWGTVCDDNWDQSDAASVCSELGCGSVIEAKSAAYFGQGSGPVWLSGVKCATGSTLRNCDSQGWGQNSCGHERDAGVTCQPKMRLASGDGSCSGRVEVFLHSQWATVYDDGWDLSDAAVVCREMGCGDAAQAKSNAYFGQGTGQTYMSNVNCVGNESSLSVCESLKPKSTDHSKDAGVICDSPVRLINGNNSCSGRVEVFYSGQWGTVCGDGWDLTDAAVLCKDLGCGDAIEVKNDNYFGQGSGPVWLSNLQCSSTDTRLRDCKSSGWRIDSCGHENDAGVICHDNVRLVNGFNPCSGRVEVLLNGQWGTVCDDGWDEADAAVVCKRLGCRSVLEIKKAAYFGQGSGTVWMNNVSCFGDESALTSCSYTRSPTSCGHEKDAGVICGLRLVDGSSSCSGRVQVLHSDEWQIVCYDGWDLLDGNVVCGQLGCGEVQEVKVAAFFGPSLEQIWMNRVNCVGNESSLADCAMESLGPTGCLKDLYAGVICQPRTRLVSGINSCSGRVEVFHNGLWGTVCDDYWGLTNAAVVCRELGCGDVIEAKSNAYFAEGSGQILMDDVNCSRDDNALSKCEFAGWGVHNCVHSEDAGVVCQAKMWLFNNFDSCSGTVAVFHNASWGAVCADDDWDLPDATVVCREIGCWKSVSVFTDYSWSSTPLRTWMNNVSCSGDETALSTCAFQGWGPDNCDPKYAGVICRLPVRLTGGRDACSGLVEVFHDGQWGTVNADGWDLADAAVVCREMGCGDAVQATGGAFGRGIGPIWMTLVDCVGSESSLIQCSLDRWLPNHVNHLNDAGVVCT

SEQ ID NO: 354 - protein, 164 aa, Xenopus tropicalis
MRDTKMLLKPPEKPPKSRKQEPMHAPKLACDEHRMGSTQLAVRLVGPNTCEGRVEVYYDQYWGTICGIYWDLNVGNVVCRELNCGTAIEASVNDKYIHYGSSWNYSGLSFFQCNGNESELLSCAYELYPHQHNPNNDGGVKCTGASGDLFSDETECAGDDIFNG

SEQ ID NO: 355 - protein, 350 aa, Xenopus tropicalis
MSDRDPTEPAFAHDKADTLLHSARPVRAPHPTLKAREAYEANKKEIADNLIALWEKTLSCVTAANETSKNTEQLNAALSRVKKAFENYKRLSEKYSFLLSRSKMEGASLELKDFTSTEQQRHSTYLEAKVLLTANLRLHKIASNSREVMKAFNPEEHAKDLKNLDLGVDALPTQRSLGLLWNVTSDTFTFQVSDTEKPFTRRGVLSTVNSLYDPLGIVTPITVQGRSILRQLTERVTDWDAPLPVDLLPKWEKWRNSLKVLEELNIPCCYSPTSLSRSKRKEIYIFCDASTEAIAAVAYLKIIDPSGRSHVGFLLGRAKLAPKDYNFVSHILQVQSDVTSSWMAYLQRVT

SEQ ID NO: 356 - protein, 676 aa, Mus musculus
MSRRALRRLRGEQRGQEPLGPDALKFVLLDDDDAEEEGPKPGLGGRRPGGAGKEGVRVNNRFELINTEDLEDDLVVNGERSDCTLPDSVSSGNKGRAKHGNAETKQDGGATKAGSSEQSNASGKLRKKKKKQKNKKSCTGESSENGLEDIDRILERIEDSSGFSHPGPPPLSSRKHVLYVEHRHLNPDTELKRYFGARAVLGEQRPRQRQRVYPKCTWLTTPKSTWPRYSKPGLSMRLLESKKGLSFFAFDHNEEYQQAQHKFLVAVESMEPNNIVVLLQTSPYHVDSLLQLSDACRFQEDQEMARDLIERALYSMECAFHPLFSLTSGTCRLDYRRPENRSFYLTLYKQMSFLEKRGCPRTALEYCKLILSLEPDEDPLCMLLLIDHLALRARNYEYLIRLFQEWEAHRNLSQLPNFAFSVPLAYFLLSQQTDLPEHELSSARQQASLLIQQALTMFPGVLMPLLEYCSVRPDATVSNHRFFGPDAEISQPPALGQLVSLYLGRSHFLWKEPAIMSWLEENVHEVLQAVDAGDPAVEACENRRKVLYQRAPRNIHRHVILSEIKEAVAALPSDVTTQSVMGFDPLPPLDTIYSYVRPERLSPVSHGNTIALFFRSLLPNYTTEGERLEEGVAGGPNRNQGLNRLMLAVRDMMANFHFNDLEVPREDNPEGEGDWD

SEQ ID NO: 357 - protein, 803 aa, Xenopus laevis
MRATGPSSAIIQHLKALGIKIRLPKKVPSPDVQRKTSSHGLFGTPLHCLPPCNMEENIPQFVVDTCQFLSSHLGTEGLFRKSGSVTRIKTLKAQLESKGCSLESAQPSDVAALLKQFFRELPQPLIPLELQEPLCQIQEMPSDKSKGSATILVTCLLPAIHVGTLKYFCTFLQRVASRCSENRMDSSNLAVVLAPNLFASTGLGERLTQSNERQLQLQTAVMQTLIDNASNIGQLPSFILSKIPLAHDAEEESVTPSGGVNRRRRRRSMSGFVNEALSKLKPGRGASVNVLDQATGEEGQHERYKSKRKASEDSGSGEHCTAKKRKSLRDITDEKLYNENLCEPVSSVSPERVFIDASPEYLSSPSTPLKLSTGSPAIPATPESAPRGQRVRGKRKENKRLKRMHSGHICVSPAQLERKEKVRSSMRLFHRTRVSKKPTLDGKNLETSGWNLMKRMVAEALEGPIFNGRDFRVAPLSLKVSGQMVPLISEDSNYKHPTSPPCLRSSPFWKSTGRSREKSETSSSAKQKRTLRRSLSMPEKLGEGTGAEEGQERTIQNEDAFSFTQEQDGILKLRAEESSELKTKVEGLNDVRDSLSTTKLGIESIHSKDDFSFHRQVSVSELHQNSQSLRRKEGHTAQYRSVRKLVLSFPWDPYINSDPYINSDPHQKDWEALATHPIKRKGARRFGRSISHESGLGSTEEQNGQISGLAPSANSPKKSLRGRSRQVFVSRKNITLSSCAQKSLETTKPDTNVVDPAGQCFINNWDLSLVQQLMEEDKQTYRSSSKYPPSATSLEPISDLIDF

SEQ ID NO: 358 - protein, 624 aa, Xenopus laevis
MDSQSLDGCIQKTLSSLYPPFEYTAATVLCQVLDVVEKTYRGDGLSYLIDFLVPAKHVLQSLQQEACLQYCGLLFRHAGWPLCIHEKIVLQLASIDWRLLQPGDFYFQVVPYLRKTPRIVLKCLARDCHNIEELVLPEVSYTSIFTLEWLEFINSGRMGTSLENCLLMSDDQIFRVPWERVVHPEFIDKTQPPDDKAGDKKATELYLECNKEMPQPAVGDLTVQHVETSVNVDSVSGEASLALDAALHIKTMMASSELEGEYVELSDISVPRLGPQMGSLTQSIALNYKSQQKPVAQQTQDKQNHVVVLDSRSCKTKVVFSDMMPTLCSLQPSTNVTFSHKPTTQQNIDIQNKIVDLTIGESMSKKHLNQEPSFSAVSETFITQNIRQRHEDISEITVPGKVSDTGDSDKCTQSCEQPSLQGGNFSTSLSFQQESRSNFINGAEDVRVMTDALQEPAAEHSRLQETVLVEYFQSSNKAVPKDLINFDITDEFDQSVPSLNATKCQFEKQKSEENTADTENKNTGSHSSFSLVAAESNAPVMLLQGDDVLNVELCSEIDEQVDDVNKELASRDLENMQLQNFQSVEQREQEPKLDSHGKNYTIVNSEQAVPHYSLCALSGSENYP

SEQ ID NO: 359 - protein, 472 aa, Mus musculus
MGCDRNCGLIAGAVIGAVLAVFGGILMPVGDMLIGKTIKREVVLEEGTTAFKNWVKTGTTVYRQFWIFDVQNPDDVAKNSSKIKVKQRGPYTYRVRYLAKENITQDPEDHTVSFVQPNGAIFEPSLSVGTEDDNFTVLNLAVAAAPHIYQNSFVQVVLNSLIKKSKSSMFQTRSLKELLWGYKDPFLSLVPYPISTTVGVFYPYNDTVDGVYKVFNGKDNISKVAIIESYKGKRNLSYWPSYCDMINGTDAASFPPFVEKSRTLRFFSSDICRSIYAVFGSEIDLKGIPVYRFVLPANAFASPLQNPDNHCFCTEKVISNNCTSYGVLDIGKCKEGKPVYISLPHFLHASPDVSEPIEGLHPNEDEHRTYLDVEPITGFTLQFAKRLQVNILVKPARKIEALKNLKRPYIVPILWLNETGTIGDEKAEMFKTQVTGKIKLLGMVEMALLGIGVVMFVAFMISYCACKSKNGK

SEQ ID NO: 360 - protein, 1132 aa, Homo sapiens
MGANASNYPHSCSPRVGGNSQAQQTFIGTSSYSQQGYGCESKLYSLDHGHEKPQDKKKRTSGLATLKKKFIKRRKSNRSADHAKQMRELLSGWDVRDVNALVEEYEGTSALKELSLQASLARPEARTLQKDMADLYEYKYCTDVDLIFQETCFPVHRAILAARCPFFKTLLSSSPEYGAEIIMDINTAGIDMPMFSALLHYLYTGEFGMEDSRFQNVDILVQLSEEFGTPNSLDVDMRGLFDYMCYYDVVLSFSSDSELVEAFGGNQNCLDEELKAHKAVISARSPFFRNLLQRRIRTGEEITDRTLRTPTRIILDESIIPKKYATVILHCMYTDVVDLSVLHCSPSVGSLSEVQALVAGKPNMTRAEEAMELYHIALFLEFNMLAQGCEDIIAESISLDTLIAILKWSSHPYGSKWVHRQALHFLCEEFSQVMTSDVFYELSKDHLLTAIQSDYLQASEQDILKYLIKWGEHQLMKRIADREPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 361 - protein, 234 aa, Xenopus tropicalis
MSRYGRYAGEAKVYVGNLGTGAGKGELERAFSYYGPLRTVWIARNPPGFAFVEFEDTRDAEDAVRGLDGKVICGSRVRVELSTGMPRRSRYDRPPARRPFDPSDRCYECGEKGHYAYDCQRYSRRRRSRTRSRSHSRSRGRRYTRSRSRSRGRRSRSASPRRSRSASPRRSRNATPRSSRSGSVKRSRSLSRSRSRSRSVSRPRSRSKSRSASPKRSRSPSRSPQRSISPERNG

SEQ ID NO: 362 - protein, 466 aa, Xenopus laevis
MRMSGTVAVKDGSEAMKGPETDMRHSTSLENLIKSEGQEKSLSDKEDSCSTNQQDAAEITQVQLSPSPAKEEQPPKVESEKEQGSEKSARKMLSRDSSQEYTDSTGIDLHEFLVNTLKSNPRDRMMLLKLEQDILDFIGTNESQRKKFPPMTSYHRMLLHRVAAYFGLDHNVDQSGKSVILNKTCNTRIPDQKFEEHIKDEKNADFQKRYILKRDNSSLDKDDNQMRMRLKEDRRSKSIEEREEEYQRARERIFAQESQENYLSDKRIQEEESNSTQQRRQIFRINKDASGRSGNSLFSSTENDSKYNEPRPWSSTDSDSSIRNLKPAVTKASSFSGISVLTRGDSTGSSKSTGRLSKAGSESSSSVGSSTGSLSHTQQQPLPVNALSQPAHGTAAVYPPVSTSNSLSFDGAINGQVTPPSASFFLLPLEATGIPPGSILINPQTGQPFINPDGTPVVYNPPVTQS

SEQ ID NO: 363 - protein, 1079 aa, Homo sapiens
MPRVHNIKKSLTPHISCVTNESDNLLDFLPDRLRAKLLPFQKDGIIFALKRNGRCMVADEMGLGKTIQAIGITYFYKEEWPLLIVVPSSLRYPWTEEIEKWIPELSPEEINVIQNKTDVRRMSTSKVTVLGYGLLTADAKTLIDALNNQNFKVVIVDESHYMKSRNATRSRILLPIVQKARRAILLTGTPALGRPEELFMQIEALFPQKFGRWTDYAKRYCNAHIRYFGKRPQWDCRGASNLNELHQLLSDIMIRRLKTEVLTQLPPKVRQRIPFDLPSAAAKELNTSFEEWEKIMRTPNSGAMETVMGLITRMFKQTAIAKAGAVKDYIKMMLQNDSLKFLVFAHHLSMLQACTEAVIENKTRYIRIDGSVSSSERIHLVNQFQKDPDTRVAILSIQAAGQGLTFTAASHVVFAELYWDPGHIKQAEDRAHRIGQCSSVNIHYLIANGTLDTLMWGMLNRKAQVTGSTLNGRKEKIQAEEGDKEKWDFLQFAEAWTPNDSSEELRKEALFTHFEKEKQHDIRSFFVPQPKKRQLMTSCDESKRFREENTVVSSDPTKTAARDIIDYESDVEPETKRLKLAASEDHCSPSEETPSQSKQIRTPLVESVQEAKAQLTTPAFPVEGWQCSLCTYINNSELPYCEMCETPQGSAVMQIDSLNHIQDKNEKDDSQKDTSKKVQTISDCEKQALAQSEPGQLADSKEETPKIEKEDGLTSQPGNEQWKSSDTLPVYDTLMFCASRNTDRIHIYTKDGKQMSCNFIPLDIKLDLWEDLPASFQLKQYRSLILRFVREWSSLTAMKQRIIRKSGQLFCSPILALEEITKQQTKQNCTKRYITKEDVAVASMDKVKNVGGHVRLITKESRPRDPFTKKLLEDGACVPFLNPYTVQADLTVKPSTSKGYLQAVDNEGNPLCLRCQQPTCQTKQACKANSWDSRFCSLKCQEEFWIRSNNSYLRAKVFETEHGVCQLCNVNAQELFLRLRDAPKSQRKNLLYATWTSKLPLEQLNEMIRNPGEGHFWQVDHIKPVYGGGGQCSLDNLQTLCTVCHKERTARQAKERSQVRRQSLASKHGSDITRFLVKK

SEQ ID NO: 364 - protein, 1212 aa, Xenopus laevis
MKLKEIERSAVQVWSPANQHPVFLATGTSAKQLDASFNTSAALEIFEVDLGDPHPAMKRRGVYPVSNRFHKILWGSFGSDLLGSSGVIITGGDNGVITLYSASQILASGEEPVIAKNDKHSSPVRALDLNPFQSNLLASGASDSEVFIWDLNNFTVPMTPGAKAQPIEDISAVSWNQQVQHILSSAHPSGKAVVWDLRKNEPVIKVSDHSNRMHCSGMMWHPEIATQLVLSSEDDRLPVIQVWDLRFASSPLKMLENHTRGILSMSWSKDDPELLLSSAKDSRILCWNPNTSEVVYELPTENQWCFDVQWCPRNPSIFSAASFDGWISVYSVMGGSIEAMQRSQADKISLSFNSLDPFGTGQPLPPLQVPQQVAQTTVIPPLKKPPRWIRRPVGVSFAFGGKLVSFDCPKASVQPNQESLPRQVYISQVSIEKEFLARSSELQAALLSGNLVNYCQNKVQSSQDVYDKSIWNFLKVNFEQDAREKYLKLLGYNKEELDKKISNALGENFQNKSSPSEPEDIIQSIQSVSSQDSSSFTGQTASNSSSVEFFNLPPQDSAKFEIPVNSDTDGLISQALLMGNFEAAVDVCLKHGRFADAIILANAGGEDLLRETQQWYFAQQKNKITTLLSSVVQHKWRDIVIKCDPQSWKETLALLLTYSKPEEYAELCDILGNRLEIEGEGKLYSEACLCYISSGNVERLVECWVKSHDITNPLALQDLMEKAMVLRKSIELLRGAELPPQGPVMAEKVAEYANLLASQGKLAAAMSILPVDSQETAVQRLRDRLLNAQGEGVRSQRNTSYEPSIQPPFGLKGSKAPEGVHYSNRQNFSQSQPGTGVPPITAVPSVFTPQPLPTAPMGPPPGVPFQTVPGLPSNTYPRPPGAWQTYPAPQPPVPAFAHSPSFKPTGHPVPNTAALPPSPVTGHLPPISTLNLTGFPTASGPMFCPPASIPSSVPAATQPVSRTFTAMGQPSTPLSMASSQPPFNYPMGASFHHGGPGAPTSLPPPPTGYFPWLQNQPNPAASEQEAWSDPHAFKAGIQRKTSNPVVPLAPITSPVMNLPNESENLQPQLSSSYDFNQAPPGAPKETSMQRMHRLPVEKIEKKEVPSEHQPLQKSFDGLVQRCSAVASDPKTKRKLEDALQRLECLYDKLRENNLSPHILAGLHEIARCVEARNYPQGLVVHTQVVSSSNFSEVSGFMPILKVLMTIASKLCV

SEQ ID NO: 365 - protein, 619 aa, Gallus gallus
MSAGGGGQRDAGTAGGRRSKWDQPGPAPAFLLSGAAPLPGRPFPGGGDGGTAVGVSESSAAPSGALDAAAAVAAKINAMLMAKGKLKPAPNTADKLQALGKGPATNKSKDDLVVAEVEINDVPLTCRNLLTRGQTQDEISRLSGAAVSTRGRFMTAEEKAKVGPGDRPLYLHVQGQTRELVDRAVNRIKEIITNGVVKAATGSSPTFNGATVTVYHQPAPITQMSPAVGQKPPFQSGMHYVQDKLFVGLEHAVPTFNVKEKVEGPGCSYLQHIQIETGAKVFLRGKGSGCIEPASGREAFEPMYIYISHPKPEGLAAAKKLCENLLQTVHAEYSRFVNQITTAVPLAGFAQPAAINSVPSQPSYYPSNGYQSGYPVVPPPQQPVQPPYGVPGIVPPAVPMAPGVLTTLPTGVPPVPTQYPISQVQPPASTGQSPLSAPFLPAAAPVKTTLPAGTQPQVQPHPQGQKRRFTEELPDERESGLLGYQHGPIHMTNLGTGFSSQSEIDGAGSKPASSSGKERERDRQLMPPPAFPVTGMKSESEERNGVGSLPGSHDHQAKKMKTSEKGFGLVAYAGDSSDEEEEHGGHKNASTFSQGWSLGYQYPSSQQRAKQQMPFWMAP

SEQ ID NO: 366 - protein, 674 aa, Homo sapiens
MLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 367 - protein, 551 aa, Homo sapiens
MDEGVNFKPTEAGRLMAWYYITFETVKKFYTISGKETLSDLVTLIAGCKEFLDIQLRINEKKTLNTLNKDPNRITIRFPMEGRIKTREMKVNCLIQAQLGCIPIQDFALTQDTAKIFRHGSRITRWLSDFVAAQEKKFAVLLNSLILAKCFRCKLWENSLHVSKQLEKIGITLSNAIVNAGLTSFKKIEETDARELELILNRHPPFGTQIKETVMYLPKYELKVEQITRYSDTTAEILVTVILRNFEQLQTKRTASDSHYVTLIIGDADNQVVYLHKITDSVLLKAGSWAKKIAVKRALKSEDLSINLISSEFVGLDIQQKLTVFYLEPKRFGNQITMQRKSETQISHSKHSDISTIAGPNKGTTASKKPGNRECNHLCKSKHTCGHDCCKIGVAQKSEIKESTISSYLSDLRNRNAVSSVPPVKRLKIQMNKSQSVDLKEFGFTPKPSLPSISRSEYLNISELPIMEQWDQPEIYGKVRQEPSEYQDKEVLNVNFELGNEVWDDFDDENLEVTSFSTDTEKTKISVLFHHMRCRIFLYQILLCPSSVHPP

SEQ ID NO: 368 - protein, 830 aa, Xenopus laevis
MRVEVVVALLLLETFPVFASVAPIHCKWSQFGAWSDCDGCSKTQTRRRTIEVYGQFGGLECYGSAYETQSCVPTRGCPIEDGCGDRFRCSSGQCISTSLVCNGDHDCEEDSLDEHQCKVLHKVCDMDKYPPNTELTGLGYNAITRKFTRSVIHTRSFGGKCRKVFGGDARDYYRLSENVLAYTFKVSVKNDFSYDFYSSSWSYVKETESRTTSNHGYYHYHKDTQSNTKEKNYQLMVIKNHVEVAQFINQKPEFLILSEPFWKELASLPSVYDYNTYRKFIDKYGTHFLQSGSLGGEYKFLFYLDSEKITANGVTKRDMQSCTSSSKNFFFVKYSSKECKALNEVIRQSSGSTDREVRGDVFVQGGEAKFVAGLSYFSLDNPLSNENRYAAWAGSVSNLPSVIKHKTTPLYELVKEVPCASVKKHYLKIAIEQYINEESPCRCKPCKNKGVPGVEGTQCVCYCKPYTYGPACQYGILAEGDPAVVDGSWSCWSSWSPCLKGTRRRVRNRVCNNPRPSGGGLNCIGDSIASELCEDSELEHLRTVEPHCFDISIVPTEFCPPAPLLENGYVQDANPPYPAGRSIAYTCKLGYTLVGDSMARCGEDLKWQAGQMKCQQIMCSPPVLPGILLVAPEKESYEIGDKITLSCAFGLDLEGPNTISCTSSLTWLPSIKNAECLAKATPTTAQSLGSQCQPWEKFEDGKCSCRMPYECGASLDVCAVDGRNNKNVALTVCKMHALQCLGRKYTLTNDAKCAFPVATERSCDSCHPWEQCKVQTNKCVCREAKTCGNEGISICVNVDGKLQTMSECEAGIRKCQGENAIVVSLSPCDV

SEQ ID NO: 369 - protein, 1090 aa, Xenopus laevis
MARASHTIKRLLRELIEIFAEDEKAAFREVGSLFQNGPDEYRSKGETKNPAGRVEKLIQYVLQRDESDCQRFLTHLENMLPSFPALADIVGGEKKRNTLIKMLESYKESKLSLRDILDIGQEDIYKVVPQTVQDLPWALLRKLMALDRTARTIQLDNISQNSGADNDSLEENIFKQMDFKRKYHESNSINPLDILCVLLHCSDMLLQQNIFSKMSMCQFAVPLLLPAGDGPECTFMLWAMRDIVKRWRPHTLAENKGFIEENLVKSEMPCFSFVRLGQIQLSKSKILNQLLSPAQQYQDFFIHENMIGGDNEREVSNGLVEISWFLPVGRENSDTFPEPVAVTNLRGDIESNWTQFSFLTQVSSAVFVFAESINKTQYELLAQCSNCSTKFHFIITPSGTSGSKETVKFLKELQPLLHFDQSHILIKDKQANEAGLVKNLQNIIQIFLRKTDKKVKLEDLANTATELGIKVDENSQECQKAKEHATEIIKEIQDVVKYKKETMKLQGNLWKQVARVEKELCRMRKQGDTNTEQYRSQLTQTLKQLHWEQNQHVLPDSMSKFIFAITYLSQSEKHYFLTWMKFALDSMARNNLSVLKEKYKKKYSKTNNQVELKKLDQQICDSSLGVEHFLREMGQFYEAECSMVNQGIIKPDKIQFSRLPGIAADLLLDGFPLELMDGDASNIPLKWVTDLLTELNNKTGGKCRMRVITVLGVQSTGKSTLLNTMFGLQFSVSSGRCTRGAFLTLIKVKENFQKKINCEFILVIDTEGLKAPELAFLEDSYEHDNELATLVVGLSDITIINMAMENTTEMKDTLQIVVHAFLRMKQIGKKPNCQFVHQNVSDVSADDNNMRDRMKLLEQLDEMTRIAGSMEKKQGIKSFTDIISYNIKRDNWYIPGLWYGVPPMASVNSGYSENVYELKKYLFTFMEKQKSIRQPYNISEFIKWIKSLWNSVKYENFSFSFRNSLVVEAYNQLAMKNSQWEWDFSKHIHTWLISTENIIKNQSADELQPEMCRVFKDNLMCLLCKEEENMLDLIKKYFESKTDNVLLIEKYREDFSRGVNCLRKDLERSVTAKIDETIRIQKGKYQKKKK

SEQ ID NO: 370 - protein, 1019 aa, Homo sapiens
GSQAAWSYITHCASRTAHNLRICPNKQTQKTAEEGTGGWLCEVLPGLSSHGGSLCSLKCLWSLCLHMALVFQFGQPVRAQPLPGLCHGKLIRTNACDVCNSTDLPEVEIISLLEEQLPHYKLRADTIYGYDHDDWLHTPLISPDANIDLTTEQIEETLKYFLLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 371 - protein, 1247 aa, Bos taurus
MVVLRSSLELQSHPAASATDSLDLSSEFLSLEQIGRRRLRSAGAAEQSAVTAAAAGDGSSVKEVETYHQTRTLRSLRKNAQNSSDSSFDKNTVITEKHANGRHFTRQLARQQADKKKEECKEDKAIAVTRSLRTRSIVQKTEHLHEESGDVEVRRSCRIRSRYGSVNQSVLFDKLITNTAEAVLQKMDDMEKQRRRRMRKLEDLEVFNETEEGNLNMYTRGKQKDIQRTDEETTDNQEGSVESSEEGEDQEDEDEDDEEEEDDDDDEDEEDVEEDNQKRYYLRQRKATVYYQAPLEKPRHQRKPKIFYTGPASPARPRYRLSSAGPRSPYCKRMNRRRHAIHSSDSTSSSSSEDEQQFERRRKRSRNRAINRCLPLNFRKDELKGIYKDRMKIGASLADVDPMQLDSSVRFDSVGGLSNHIAALKEMVVFPLLYPEVFEKFKIQPPRGCLFYGPPGTGKTLVARALANECSQGDKRVAFFMRKGADCLSKWVGESERQLRLLFDQAYQMRPSIIFFDEIDGLAPVRSSRQDQIHSSIVSTLLALMDGLDSRGEIVVIGATNRLDSIDPALRRPGRFDREFLFSLPDKDARKEILKIHTRDWNPKPLDMFLEELAENSVGYCGADIKSICSEAALCALRRRYPQIYTTSEKLQLDLSSINISAKDFEVAMQKMIPASQRAVTSPGQALSTIVKPLLQSTVHKILEALQRVFPHAETRTNKALDSDISCPLLESDLAYSDDDVPSVYENGLSQKSFNKAKENFNFLHLNRNACYQPMSFRPRMLIVGEPGFGQGSHLAPAVIHALEKFTVYTLDIPVLFGVSATSPEETCAQVIREAKRTAPSIVYVPHIHLWWEIVGPTLKATFTTLLQNIPSFAPVLLLATSDKPHSTLPEEVQELFIHDYGEIFNVQLPSKEERTQFFEDLILKQAAKPPISKKKAVLQALEVLPVAPPPEPRPLTAEELKRLEEQEEDTFRELRIFLRNVTHRLAIDKRFRIFTKPVDPDEVPDYVTVIKQPMDLSSVISKIDLHKYLTVKDYLSDIDLICSNALEYNPDRDPGDRLIRHRACALRDTAYAIIKEELDEDFEQLCEEIQESRKKRGCSSSKYAPSYYHVMPKQNSTPAGDKKSDPEQSEKPNRPSTPMACSTPEMCVLRMTRARRSQVEQQQLISVEKALAILSQPTPSLVVDHERLKNLLKIVVKKSREYNIFQLENLYAVISQCIYQHRRDYDKTALIQKMEQEVENFSCSRS

SEQ ID NO: 372 - protein, 1034 aa, Xenopus laevis
MVPWLLLLLPAFIQNLNLDKKPQTLSGPPGSHFGFSMDFYNTADQGMSIVVGAPRMQTSQRNVTMGGGVFLCPWKPKGSSCVNIKFDSTGDRSIPFAGYTMKIFKSNQWFGATVRTWNTAIVACAPFQQWNVMKLGSESGTTPTGTCYITNNLEDIYEFAPCRESKMERHYEADRRFCELGFSTDINKDGTLLAGAPWGYFQGLYVTAGLPNILARPASSSLLQSYPGQQISPYIGSSFDSYKGFSVAYGEFTGDNTPEIVVGSPKYQDRGLVDIYTVSNPWKTFISFLGKQVASYFGHSVAVTDVNNDGRDDVLVGAPLFMERRTRGKLQEFGQVYVYLQRENRKFSFNHPVLTGSQVYGRFGSSIAPLGDIDQDGFNDVAVGAPFGGESGGGCVFIYRGSPAGLSPQPSQILESPLPPPAQFGFALRGGMDIDNNGYPDLLVGAFHADKVFIFRTQPVVVLQASLFFNPEALNPDEKLCNFPQSGPAVSCFTIRVCAQASGRSLPKKISLSAELQLDRLKSRFARRTFFLDSSQPSKTIDMELQSNSAQLCQNLTPYLRGESEFKDKLSPIAMSVNFSLVRAQSMDTVQPTLHGTTFLQEQTNILLDCGDDNVCIPNLHLTANWSADPLLIGIDNLVHVQFNAANLGEGAYEAELYVWLPNGAHYMQVLGEAEEKILCSPKKGNESEIVVCELGNPMKNGAEIHADLQLSFSNLEDSGSTVTFQMQIKSRNTVNSASSLFLVTMAVKVTASLELRGSSHPAEVILPLPNWEPREEWRKAQDYGEEVTHVYELHNSGPGSVHVQLLLQSPEMYHGDYFLYPLRLEVDDGMTCDNQSALNPLKLDILTSTEEPANYSSRSGDHRLERRDLRRWGADEGMQEDGVNITKKDEKPPRNHTVLLNCSSFPCWEVQCSVQNLERGGRATVKLHSILWVPSFLKRQQQQFVLLSQGSFWVTSVPYKIQPAVLLYGNATANTTVLWVSPDGQKEIPLWWIIVGALGGLLLLALFVFVMWKLGFFRRTRPPSDDQEDLTSD

SEQ ID NO: 373 - protein, 1896 aa, Mus musculus
MDAGSGPLRSAGPLPGNSLSCRPRGPYGDAGLPGSSAGCDPPARRGAAGGPERRERAEAAAARARLTLEGVAVASRIPPSLPARVPPRCSRRVRLLFAEPRAPEPRRRGGELAGLRGGRAAPGGAGALASAGLGVRGGDRRAGCSRGPGALRGRGEAEGAGTGRSRSRSRGAWRRSGRALRAPSGGEAARRGAGPERSPRTQETGAQSRPERRERIRDPPQGHPSRPLPGHARRSLRPGEAAMETPAGESSARGYGPPPAPAPAAERKKSHRAPSPARPKDVAGWSLAKGRRGTGPGSATACGTASSARPDKKGRAVAPGTRGTGPRVAGVRTGVRAKGRPRPGTGPRPPPPPPSLTDSSSEVSDCASEEARQLGLELALSSDAESAAGGPAGTRTGQPPQPAQSGQQPPRPPASPDEPSVAASSVGSSRLPLSASLAFSDLTEEMLDCGPGGLVRELEELRSENDYLKDEIEELRAEMLEMRDVYMEEDVYQLQELRQQLDQASKTCRILQYRLRKAERRSLRAAQTGQVDGELIRGLEQDVKVSKDISMRLHKELEVVEKKRMRLEEENEGLRQRLIETELAKQVLQTELDRPREHSLKKRGTRSLGKTDKKPTAQEDSADLKCQLHFAKEESALMCKKLTKLAKENDSMKEELLKYRSLYGDLDAALSAEELADAPHSRETELKVHLKLVEEEANLLSRRIVELEVENRGLRAEMDDMKDHGGGGGPEARLAFSSLGGECGESLAELRRHLQFVEEEAELLRRSSAELEDQNKLLLNELAKYRSEHELDVTLSEDSCSVLSEPSQEELAAAKLQIGELSGKVKKLQYENRVLLSNLQRCDLASCQSTRPMLETDAEAGDSAQCVPAPLGETLEPHAARLCRAREAEALPGLREQAALVSKAIDVLVADANGFSVGLRLCLDNECADLRLHEAPDNSEGPRDAKLIHAILVRLSVLQQELNAFTRKADVALGSSGKEQPEPFPALPALGSQGPAKEIMLSKDLGSDFQPPDFRDLLEWEPRIREAFRTGDLESKPDPSRNFRPYRAEDNDSYASEIKDLQLVLAEAHDSLRGLQEQLSQERQLRKEEADSFNQKMVQLKEDQQRALLRREFELQSLSLQRRLEQKFWSQEKNILVQESQQFKHNFLLLFMKLRWFLKRWRQGKVLPSEEDDFLEVNSMKELYLLMEEEEMNAQHSDNKACTGESWTQNTPNECIKTLADMKVTLKELCWLLQDERRGLTELQQQFAKAKATWETERAELKGHASQMELKAGKGASERPGPDWKAALQREREEQQHLLAESYSAVMELTRQLQLSERHWSQEKLQLVERLQGEKQQVEQQVKELQNRLSQLQKAAEPWVLKHSDMEKQDNSWKEARSEKTHDKEGVSEAELGGTGLKRTKSVSSMSEFESLLDCSPYLAGGDARNKKLPNGPAFAFVSTEPVEPEKDAKEKAGLSTRDCSHIGSLACQEPAGRQMQRSYTAPDKTGIRVYYSPPVARRLGVPVVHDKEGKILIEPGFLFTTAKPKESAEADGLAESSYSRWLCNFSRQRLDGGSGASTSGSGPAFPALHDFEMSGNMSDDMKEITNCVRQAMRSGSLERKVKNTSSQTVGVATVGTQTIRTVSVGLQTDPPRSSLHSKSWSPRSSSLVSVRSKQISSSLDKVHSRIERPCCSPKYGSPKLQRRSVSKLDSTKDRSLWNLHQGKQNGSAWARSTTTRDSPVLRNINDGLSSLFSVVEHSGSTESVWKLGMSEARTKPEPPKYGIVQEFFRNVCGRAPSPTTAAGEESCKKPEPLSPASYHQPEGVSRILNKKAAKAGGSEEVRPTMLSQVGKDGILRDGDGSLILPSEDAVCDCSAQSLASCFIRPSRNTIRHSPSKCRLHPSESGWGGEERAAPQ

SEQ ID NO: 374 - protein, 365 aa, Xenopus laevis
MVTCSMRCTEEGLLGATLAFSSGKRKRDSVYSPGDATPGDRGEGEPKCPSVGTKKRAKYSRHRKQSLELRSCDSGVADLYETPSPSPVAPSPTHEPWDTCTPMYDGLGLQNFRDYGQDCYTFNKSLEDKFLAVNCLKNQPQIQAESRCKLISWLIPVHRHLNLGFESLCLTVNILDRFLACTPVASDCFQLVGVTSLLIASKQVETRPPRVKQLLALCCDAFSREQLCNLECIILLKLHFRLGAPTINFFLQHFSLLRVTNEESSDTELSETTKSVTVARGIAELSLADYAFNSYSPSLMAVCCLEIADRMLCHRNPIRARVSDYHESLIQECVGKIDLLVSLNQDSLHRLLPSQFAVKSINVDN

SEQ ID NO: 375 - protein, 353 aa, Xenopus tropicalis
MVTCSMRCTEERLLGAPLDSGKRKRDSVSPGDATPGDRGEGTKRAKYSRHRKQRLELRSCDSGVADLYETPSPSPVAPCPTYEPWDTCPPMSDRLGLQSFRDYGEGCYLFNKSLEDKFLTVDCLAHQPQIKAESRCRLISWLIPVHRHLKLGFESLCLAVSILDRFLACTPVASDCFQLVGVTSLLIACKQVETRPPRVKQLLALCCDAFSREQLCNLECIILLKLHFRLGAPTINFFLQHFSLLRVTSMESSDTELSEATKSLTVARGIAELSLADYAFNSYPPSLMAVCCLEIAERMLCHRNPISVRVSGYQESLIQECVGKIDLLVSLNQDSLHRLLPSQFAVRSIKVEN

SEQ ID NO: 376 - protein, 557 aa, Xenopus tropicalis
RSRGAEGGAEREDNGTAGLSNSDRDCPGNSGPVGRSRLEEGMAEVPLYDKINEDSQGDTEPNSLLQKLRNKITKPVQTKVDNILQDVQKLTDYDKLYLYLQLPAGPSAPEKSLDIGSVNTAEHMHACTWIRNHLEEHTDTCLPKQDVYDAYKRYCDNLHGRPLSVANFGKIIREIFPNIKARRLGGRGQSKYCYSGLRRKSVVSLQPLPSLDLKMAESSELTDLVQSYNNDVINASCALICNWAEKILKRSFNNIVEVAHFLIQQHLINPRSANAELVLSMVLSENSQGGTQKTQKQPADGAGNKGSESPEGGGDAGTKSKTTSPNVGSPQQPPKKRPPEQQKAASNPQVDALVAKYPPVLPRPTEKITPIRLTPQVLAPKIIPGSLPFTAVSSGTSLTVAAGINGAGLVPQPVIMIQPDMVSLETHPLPKAPHNSTKERAAGGGETKGLKRRAEGDPAAGATAKRKRGRPRKVGSTPNDLAPSCLATARGPASAPSDAPGQDSVPEFYTGGALPAAPRASVRGETLKPSAQPPSAELQESAGAGTTKAQAGSAPIQ

SEQ ID NO: 377 - protein, 673 aa, Tetraodon nigroviridis
MSSAASPTRRNDPSPVESRIKQDKSDFEEQERQRVTQEARAEKQQKKKERELVLKRIAEDRKSQQEKMQTGAASEKSPPGGQEQKLGGKIQTNVDNNCLLMGFPRKRFGEAELTCSLRSLGLTPNAALCIQTTPPETPHDTHSPADPPSAGQSAPSPCKASPQPRILAPEGAEGQDPVVPPPLPNQLEAPEEDAVEVEDAGAPGAPVAAGLAAVERLQRAGHHEHPPTSQGQPSPPKRPFKTPSLPSLCALATRATLQLMSAPSMQYSSSLAGLTPELVELLLNHMSRERLLRPRSLELFFGCPLQKFVLNCYPYCTNELLRQLRAFPALRHLSLVNSPLITGLKNLCFLSLDQTKVTDAGMVLYLHSAPSCLAQLSLNQTAVTEATLAVLPSCTPQLRLLSIKQTKVRDVAALARLSGLHTLNLDGTDVSESGLEHLASHPLLSSLSLAGISVTDGNQALQIISGLNLTQLTLPGRRSVTDSGLASVCRLTLLTELDLTDYTQVTDQGVAQLASMRRLKKLSLSNTQVTDAGLSPLRGLQELQDLCLDRTAVTSRGVAALIACLPHLQVLGLACTQVGDTVVRRGLLRCPQLVKLNLSRTRITDNGEVHLHTHTHTDPSRARAGVGSPSVSHRSEVLKTHAPGSRESGRHWCELGGHRRPPDRHKHQQHPRQ

SEQ ID NO: 378 - protein, 291 aa, Xenopus tropicalis
MATASSNRGAVVLGLLCACLWTAAFAGVSTPNPTITVKQGATADLRCTYTSDFTKSRVEWKFVNNQLETFFVYYDGTLTASYVNRATSVPQGIILNQITSKDAGEYSCEVTSVDSNGQTLYGEAKIQLLVIVAPSQPMAHVPNTVRTGSAVELRCVETQGYPPPTFTWYQNKAPMPPNPQNATYTIDPNTGVLKFRAVAASDSGDYYCKAANSEGEQVSAIVRMNVQDVNVGGIVAAVVIVLLILALIGFGLWYAYSRGYLDKKGNKKVIYSQPSETRSDKNFQQTSSFLV

SEQ ID NO: 379 - protein, 1564 aa, Xenopus laevis
MSNKEVKAILKNARDAIRNKDYKEVLKQCKAVLKLEKNNYNAWVFIGLAASELEQPDQAQAAYRKAVEIEPDQLLAWQGLGNLYEKVNQKDFKEDLPNVYQKLLELYRSSDKQKWYEICKKLSDLYQQEKNYVPAAHTWHQLIKMKEDESIKSNELYPLWKRMTELLSEDVEKLDNETQELLLNAFESAIPCIEEIPSEEHQMLYQHYITCLSKLPLEEAKLKKVCENMITVYPSLIYPLKVLALHYIKSGDITEEAICCYSKLLELDPLNGPGLIGMGIKALHDRNYVLASENLSKGLKDVNCCPSAWCCLAQAQLKIHKYAEALVSCDQAINGATQDNSAPQSVVQKDAAFRLKAEALVEGNSSNNAEEALKALEQISNADNNPEICAIKGQAYLKKGCIDVASKISEELRLSHEHLAEGHFLEGLLQYIQKNYSAAEISLQYALERKPENAVYHYYLGLNYWFMSKETRRDKTKAVTQFLKAAKMDPFMSRAFYYLGHYYSEVAGDKSRARGCYKKAFELDDSDGEAGAAAVDLSMELGDMDVALAILTSVTERADAGTAKWAWLRRGLFYLRVGQHSKSVSDLHAALRADPKDSNCWECLGEAYLSRGGYTTALKSFMKASELNPDSIYSVYKIASIKQILGTYKEAVNEYQQILMKSGEYVPALKGLGECHLMLAKSALSDFLDLKAVDAIEKAIEFLARAIRLRPDLLCLWKLLGDACTCIYAVTHSSVKVNVLGILLGNDEEQQLLNKPEVLALGGRCYGRALRIQSTANLWCDLGINYYYQSQHLMGYDSLTNDASELLEKSQQCIKKAVMVESGNHQFWNALGVVSCSKGMGNNALAQHAFIKSIHCEQNNVAAWTNLGALYLMNGNIELSHQAFKVAQSLDPLYVRCWIGQALIAETVGSHETMDLFRHTTELSMHVEGAKGYAHWVCTTLQDKNNRNTALYRYNIVQMNAITAAHLALSKYTERIQNDRTAFEMLGYLNEHLNLKKQASESYRRVVSILQEREDKESSNSALQHYGRSLCAVGQYQEAIQTFSSTPLTEFDDLTGIALAFFKKGLLQESMKAYKQALSVAKSDQEKAHILTALAIIEYNRGEFDTAKTLLFKCSVLKEPSIESLQSLCALGLAKRDVTLATAALNELLKHVKIKDNIYERCLITSAIYVLQGRNEAAQRQACRDIHSHPGNPELWAFLSRLVPQHVPRDAKGGAVAGTVAYTLNINHSKKALLYAAVNELSAGALLADDRKKNALNTLQRAAHFFPDNPAVWASLMAACEAENTASYLNKKSNKKTDLSLTFLASVKSKTEGMKAVPASYTQTLRSWSLCQAICALKDQGRISEAEALCTKSIQNCPDQTPFFLLLRQIQCKQLQSQAQISEPVLEELKKTVLSNFTSHNAWHWLAEVYQSLGMMMDAEMCYRKSLQLASQQGNWNGKLSSLLRLALLALKVCMAKIPDSRWPGLLQEATSEVLKMTFCPLAVLLQGILQFSTKGSRKTRQLLEKVVYQSGCSDTIAFVARWYLLRHLHGKNDDQLVEVLLDNAKAHGDTRIIDLHKQLTESS

SEQ ID NO: 380 - protein, 1131 aa, Xenopus laevis
MSVSATENDVPRFFVGCEESDELLDQSKPENLDNLYEHTEDEEDEEDDEYDSPPERQIVVGICAMAKKSKSKPMKEILERLSLFKYITVVIFEEEVILNETVENWPLCDCLISFHSKGFLLDKAVAYAKLRNPFVINDLNLQYQIQDRREVYRILTNEGIMLPRYAVLNRDPNKPEECNLIEGEDHVEVNGEIFQKPFVEKPVSAEDHNVYIYYPTSAGGGSQRLFRKIGSRSSVYSPESSVRKTGSYIYEEFMPTDGTDVKVYTVGPDYAHAEARKSPALDGKVERDSEGKEVRYPVILNAREKLIAWKVCLAFKQTVCGFDLLRASGQSYVCDVNGFSFVKNSMKYYDDCAKILGNIIMRELAPVFHIPWSIPLEAEDIPIVPTTSGTKMELRCVIAVIRHGDRTPKQKMKMEVRHQRFFDLFEKYHGYKTGKIKLKKPKQLQEVLDIARQLLVELGQNNDSEIEESKAKLEQLKTVLEMYGHFSGINRKVQLTYLPHGCPKTSSEEEDCRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQHRVKARLHEILQRDRDFSSEDFEKLSPTGSVSQIKSMHFIKNPVKTCDKVYSLIQSLTSQIRQRMEDPKFADIQLYHSETLELMLRRWSKLEKDFKTKNGRYDISKIPDIYDCIKYDVQHNCSLKLENTMELYRLSKALADIVIPQEYGISRPEKLEIAKGYCTPLVRKIRSDLQRTQDDDTVNKLHPLYSRGVMSPERHVRTRLYFTSESHVHSLLSILRFGALCDETKDEQWKRAMDYLNVVSELNYMTQIVIMLYEDPNKDVSSEERFHVELHFSPGAKGCEEDKNLPSGFGYRPASQENESSKKHTHANDSDEDLGVCRRDEPDRALVMFKPMVSDPIHIHRKSPLPRSRKIGSVEVLSDNNSHLRTARLLEQKHIGLGFELYSMVPSICPLETLHNSLSLKQVDEFLSAVAAPSSDYQMDTPTASPSTPGFYTYVGGRKISLNTYTPTKILPPLFPVSTDVEMSDSVFQSCSSTSMVPGLAGSADNTERNHQAQDD

SEQ ID NO: 381 - protein, 423 aa, Xenopus tropicalis
MGDSATDRENRAPRKHRHHQENDLSSERNIHKPHNKHMQENDQYSKQYHNERTPSRNKQERSRNSYPERDQMCEEKKSQTWSEQREKYYREKEASRNQQERSQGRYDDKDGYYKERGQDRSQKDMSQKQYLEKENYHKETEKGRRNTEKSQNDYHERDEYRENYSYNKDRHQYPMDSKEQERYYADQRTFSVHGSNMEYVEEHETDGGILDCHKCRYLCTSRALCQLLEVLFNMLILICCSVSYNSTGGYTGITDLGGIYYYAYGGAYSGFSGADGQKAQQLDVQFYQLKLPTVRASMGFGGALMAFCCLLVLLGVLRVPWHFPIVLLVECVLDILIAVGYLPALYFYFKYLQDAYNSQVCKDRESLYSSKGYQGFTCSLHAADIAAVLFACMAVIAFFLSAALAIKGYRRVRQLKKKPNNYV

SEQ ID NO: 382 - protein, 508 aa, Canis familiaris
MRRLPRAAMLPLPLALLVAAGAPEPPVSAPRILAWGPGLRAGVVLPVRYFYLQAVNSEGRNLTRSPADQTLFRVIIKSLSPKELVRIHVPKPLDRNDGTFLVRYRIYDTVSAGLKIEVLYGDEHVAQSPYILKGPVYHEYCECPEEDPQAWQRTLSCPTKEPQIAKDFASFPSINLQQMLDEVPKRFGDERGAIVHYTILNNHIYRRSLGKYTDFKMFSDEILLSLARKVLLPDIEFYINLGDWPLEHRKVNETPGPLPIISWCGSLDSRDIILPTYDITHSTLEAMRGVTNDLLSIQGNTGPSWINKTEKAFFRGRDSREERLQLVQLSKENPELLDAGITGYFFFQEKEKELGKAKLIGFFDFFKYKYQVNVDGTVAAYRYPYLMLGNSLVLKQDSKYYEHFYMALQPWKHYVPIKRNLSDLLEKIKWAKENDEEAQKIAKDGQLAARDLLQPHRLYCYYYRVLQKYAERQSSRPKIRDGMELVPQPDDNTSMCQCHRERPFREEL

SEQ ID NO: 383 - protein, 522 aa, Xenopus laevis
MATVREKAVALDLCATYSPSQRPPGPNGSHRPFRATYIWSSIIQVLYTQVEVKKRRHHLKYHHDCFIGSEAVDVVFAHLVQHKYFGDMDIPRSKVVRVCQALMDCKVFEPIVTACMFGREKKRTVFEDSSCSLYRFLNSSNLLGVQVEKSNGRCTPQRPKHSSFQSASLQSPSLEDLWDNLSLTPADPTHINLTSNLPPKVVAEVWQEQTIRRLLQLVDLPLLDSLLEYTPVAPRIPNVKEEDHNLTSNYLDREILKAFSDAQADEWVSAAVDCLDFLPDHMVVDVSRNLPEQQAPDSKWKLLLFDTIGKHYSQNRAPLLRNQLFDIHTGIAELLVNGKTEPALEATQLCLKLLDSPSREEFRRLLYFMALAADPSEFRLNEETDNRMTVKRMFCRAIVNNKSLSKGKCDLLVLFILDHHKDVFKIPGSLHKMVSDKLVAIQQGTDPDRDTGYTFCQRVDKREFDSAAQNNTRTELCALLKTIYENNSLSPKEKKRLLGQFYKSHPETFIQYFGDRVSSVYT

SEQ ID NO: 384 - protein, 800 aa, Xenopus laevis
MNRTIGHSSDPLQSEDQEVGFDPLQSDTGKQEEFSPEKRTNPASDSEQIFISYSKEWEELFVNNNYLATIRLKGINGQLRSSRFRSVCWKLFLNVLPQDRSQWISKTEELRTLYEKIKEIHITNPRKAAGQQDLIINNPLSQDEGSLWNKFFQDKELRAMIEQDVKRTFPEMQFFQQEYVRNLLTDILFCYARENEHLLYKQGMHELLAPIVFILHCDHQAFSHASEAAKPSEEMKALLNPAYLEHDAFALFSNLMRSAEPWFSTFEHDSRKEKEAMLSTMPFARPQDIGPSIAIVSKVNYIQDQLLKKNDIELYMHLNRLEIAPQIYGLRWVRLLFGREFPLQDLLVVWDALFADSITLDLVDYIFIAMLLYIRDALISSNYQTCLGLLMHYPPIGDVHSLILKALFLRDPKKNPRPVNYQFHQNLDYYKARGLDLLNKSRVNSKPGSSAMVKVSSSLMSFGRKLMGPTVPTGGAMSPMLSAQNSNASSFSSSPGLTKSLPNQIVAEPNPHPFPSVQQMQQTQRMMKSESMPVQLSKGQSSKNMSSSPSIESLPGGRDHTDSPPLSAGKKESFFSNISRSRSHSKSQGKKENEEDMEAQISFLQGQLNDLDAMCKYCAKIMNTHLGHIQDVILEEKLEKEDKIQVSLAVLKQIKDILKGTLRFNQSLLEAEENEEISIMDDHYCSNLLRKTDETGTQEQPRHNQAAAESSGNAASSKCEDYIVIPRGDDGNAEAASLELKQGDVVKEDPTETNQIPSRSSLAFTDPLMGGSASCSSSPDDDSSNNSKDSDFTIVSPLDI

SEQ ID NO: 385 - protein, 334 aa, Xenopus tropicalis
MPKRLRRFALLMFMFMTCRFFYRIANVQPSAHSQWPLPSAPPPPISPAEVLRDGNGIIFIETTDRMKPPSLVLCTIESAARVYRHRPVVFFMEGLRDITAMRDALKRLPTLSSFHNVHLFPLQMERLFHGTPLRRWYEKVNPERERYWTHVSSDGCRLALIWRHGGIYMDSDFISMRPIPTGNFLAAESSDFSSNGIFGLTPRHSFAWKGMESFVRNYRGAKWGHQGPQLFTRVLKQYCIAPRFQSTEDVKCGDISILKVKRFYPIPYESWRRYYEVWQNVPKFRDSYALHLWNYLNRGQKTMVPGSNTLVEHLYQLYCPTLYGALRRNESIYG

SEQ ID NO: 386 - protein, 769 aa, Mus musculus
CPFSIMQPPPRKVKVTQELRNIQGEQMTKLQAKHQAECDLLEDMRTFSQKKAAIEREYAQGIQKLASQYLKRDWPGIKTDDRNDYRSMYPVWKSFLEGTMQVAQSRINICENYKNFISEPARAVRSLKEQQLKRCVDQLTKIQTELQETVKDLVKGKKKYFETEQMAHAVREKADIEAKSKLSLFQSRISLQKASVKLKARRSECNTKATHARNDYLLTLAAANAHQDRYYQTDLVNIMKALDGNVYDHLKDYLIAFSRTELETCQAIQNTFQFLLENSSKVVRDYNLQLFLQENAVFHKPQPFQFQPCDSDTSLKAAQLVDIELSPVSALRMTIAESRQLESETGTTEEHSLNKEARKWATRVAREHKNIVHQQRVLNELECHGVALSEQSRAELEQKIDEARESIRKAEIIKLKAEARLDLLKQIGVSVDTWLKSAMNQVMEELENERWARPPAVTSNGTLHSLNADAEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFSGRIGVFPSVLVEELSASENGDTPWTREIQISPSPKPHTSLPPLPLYDQPPSSPYPSPDKRSSQFFPRSPSANENSLHAESPGFSQASRQTPDTSYGKLRPVRAAPPPPTQNHRRTTEKMEDVEITLV

SEQ ID NO: 387 - protein, 1904 aa, Canis familiaris
MQSRLLLLGAPGGPGGPAARRVRLLLRQVVRGRPGGAGRAEVRLLQAGAGADTGETVNIGDVSYKLKTPKSPELVPQNYISDSVVQSVIQHLKWMMQKDLLGQDVFLIGPPGPLRRSIAMQYLELTKREVEYIALSRDTTESDLKQRREIRAGTAFYIDQCAVRAATEGRTLILEGLEKAERNVLPVLNNLLENREMQLEDGRFLMSSERYDKLLQDHTKTELDAWKIVRVSENFRVIALGLPVPKYSGNPLDPPLRSRFQARDIYYLPFKDQLKLLYSVGASVSAEKISQLLSFATTLCSQESSTLGLPDFPLDSLPAAVQILDSFPMMSIKHAIQWLYPYTILLGHEGKMAVEGVLKRFELQDSDSSMLPKEVVRVERLVDSPAPQAAVTVRIAEKEVTIQVPAGTRPINQPCASDHFIQTLSHKQLLAEMMQSHMVKDICLIGGKGCGKTVIAKNFADNLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPVHPSFRIIALAEPPVIGSTTQQWLGPEFLTMFLFHYMKPLVKSEEIQVIKEMVPNIPQEALDRLLSFTHKLRETQDPTAQSLAASLSTRQLLRISRRLSQYPNENLHSAVTKACLSRFLPSLARSALEKNLADAEIEISTDNHQEPELENYKCEIASGNLRIGAISAPIYNTHEKMKVPDVLFYDNLQHMIVMEDMLKDFLLGEHLLLVGNQGVGKNKIVDRFLHLLNRPREYIQLHRDTTVQTLTLQPSVKDGLIVYEDSPLVKAVKLGHVLVVDEADKAPTNVTCILKTLVENGEMILADGRRIVANSANVNGRENVIVIHPDFRMIVLANRPGFPFLGNDFFGTLGDIFSCHAVDNPKPHSELEMLRQYGPNVPKPILEKLVAAFGELRSLADQGIINYPYSTREVVNIVKHLQKFPTEGLSSVVRNVFDFDSYNNDMREILINTLHKYGIPIGAKPTSVQLAKELPLPEQTFMGYWTIGQSRNGIQKLLCPTETHHIDIKGPALINIQEYPIERYEERSQTFTEECASWKLPLDEINLICDIATSSENEENTLYVVACNPITLYFMNMAGKSGYLVDFSDIFPRTAGRVWHPFVTVAPLGNPLKDQVILHEQQSNVILLLDTTGQALRRLILPSEEVPSKKPSWWSKEDTETYKMCKEFSHKNWLVFYKENGNNLTVLDVLEGRTHTISLPINLKTVFLVAEDKWLLVEDKTNQKYLLTKPAHIESEDSGVCQLYMLKEEPPSSGFGVIQETDLSIPHKISSDQLSSENLSSAVGQKIASPNRILSDKNSYATVVIGFPDLMSPSEVYSWKRPSSLHKPSVTDTTFYGGKKKSETPKQSNCVTLLDTNQIVRILPPGEVPLKDIYPKDVTPPQTAGYIEITDLQSKKLRYIPIPRSESLSPYTTWLSTISDTDALLAEWDKGGVVTVDMGGHIRLWETGLEHLQRSLMEWRNMIGQGDRQMQITIHRDSGKDVSSPKHGKEDPDNMPHVGGNTWAGGTGGRDTAGLGGKGGPYRLDAGHTVYQVSEAEKDAVPEEVKRAAREMGQKAFQQRLKEIQMSEYDATTYERFSGAVRRQVHSLRVILDNLQAKGKERQWLRHQATGELDDAKIIEGLTGEKAIYKRRGELEPQLGSPQQKPKRLRLVVDVSGSMYRFNGVDGRLERSMEAVCMVMEAFENYEEKFKYDIVGHSGDGYNIGLVPLNKIPKDNKQRLEILKTMHAHAQFCMSGDHTLEGTEHAIKEIVKEEADEYFVIVLSDANLSRYGIHPAKFAQILTSNPQVNAFAIFIGSLGDQATRLQRTLPAGRSFVAMDTKDIPQILQQIFTSTMLSTV

SEQ ID NO: 388 - protein, 624 aa, Xenopus tropicalis
MATTALSRDPFLGVNFPSQKPLSQRVVRHALAILHLLTNQGDMLVPTDSGSSLELGKRNHEKKVKVDQVMKLVLGIIHLLNEGQMEEASVSFSAEEWGSLEKEQRDLYKDLLMENDETLRSLNSFSVKTESCSRAEREELHIKDPPEDPPPDLHPNTFPCTDAPGRGIKATPLADVMGTSYSMDPYQGADSATFPKLLGPGTPTSIIPNPPTNSSAMEHSIGTYPSNPAMEQSIGTYPSNECSVSTYPNHSGTEGPVTTYSDTCISADPISSSPRTLSESCKDSYMDSYPSTMTEPSMIPASGTACGALISHFIGTYPGSSPEAFPGNMAAIHIKQEGSPPDGPSGKWTVAAAPYSPANGSGGGPLKKQGKVAKKPPPRAPGHSSEKQREARWSPDKAQTVGENPRGHAGRFDSRAPHRKHPGKKPFECMRCDKSFKCRSHLVMHQRVHTRERPYVCTECGKSFTQSSNLFRHQRGHRGERPYVCTECGKTFTQSSYLLIHQRTHTGERPYSCTHCGKSFRVSSTLVRHQRVHVGEKPFGCTKCGKRFTQSSYLLIHERTHTEERPFSCTVCGKGSKEQTGRSLNSQSLSQSPAPLNLLDGGAPCWALHSGRFCPADLSGQGQE

SEQ ID NO: 389 - protein, 583 aa, Xenopus tropicalis
MGMWEEASDPVMGKKDKNEERKERILNLTLEIIYLLTGEGYVIPKKKSPTVGLGALHAPGSVIQKENDKKILELISNIIQLLTGEVAIRCEDVSIYFSLEEWEYIKGNQALYREGIKEEEEEPQQLRPLACEYKDGSDVTAHTEATLCCNNDGNLTNPDVSPAEQPPPANGIKEEVASWKEGNQSDCSINPLTEQIQGTDTPTPIMGCSLNSSSAEDYISVVIKEEAASWEGGNQSDCSINPLTEQIKGTDTPTPIMGSSLNNSSAEDYISVVIKEEAASWEGGNQSDCSINPLTEQIQGIVAPIMGCSLFNTTYNGYENADTFPHISGIMHNTYSYSQYNNHFGYQRDFYKPQESHKKKRFPCPDCGRCFSHRPNLERHQRIHTGEKPYPCSYCGKFFASQPNLDRHHRTHTGEKPFPCPECGRCFASSSELIVHQRTHTGVKPFPCPECGKSFTNSTRLRDHHRTHTGEKPYPCPECGKCFSNRINLASHKKTHTGEKPYFCTECGKCFGKQSHLSRHKRTHTGEKPYPCLECGKRFSDRSVLNKHQITHTGEKPFPCTICGKCFSYKNNLKTHSYLHNKP

SEQ ID NO: 390 - protein, 3726 aa, Mus musculus
MEGCDSPVVSGKDNGCGIPQHRQWTELNSAHLPDKPSSMEQPTGESHGPLDSLRAPFNERLADSSTSAGPPAEPASKEVSCNECSASFSSLQTYMEHHCPGTHPPPALREESASDTSEEGEEESDVENLAGEIVYQPDGSAYIVESLSQLAQSGAACGSSSGSGAVPSLFLNSLPGVGGKQGDPSCAAPVYPQIINTSHIASSFGKWFEGSDPAFPNTSALAGLSPVLHSFRVFDVRHKSNKDYLNSDGSAKSSCVSKDVPNNVDLSKFDGFVLYGKRKPILMCFLCKLSFGYVRSFVTHAVHDHRMTLSEEERKLLSNKNISAIIQGIGKDKEPLVSFLEPKNKNFQHPLVSTGNLIGPGHSFYGKFSGIRMEGEEALPAVAAAGPEQPQAGLLTPSTLLNLGGLTSSVLKTPITSVPLGPLASSPTKSSEGKDSGAAEGDKQESGGHQDCFSEKVEPAEEEEAEEEEEEEEEAEEEEEEEEEEEEEEEEASKGLFPNDLEEELEDSPSEESGPPAGGTTKKDLALSNPSISNSPLMPNVLQTLSRGPASTTSNSASNFVVFDGANRRSRLSFNSEGVRANVAEGRRLDFADESANKDSATAPEPNESTEGDDGGFVPHHQHAGSLCELGVGESPSGSGVECPKCDTVLGSSRSLGGHMTMMHSRNSCKTLKCPKCNWHYKYQQTLEAHMKEKHPEPGGSCVYCKSGQPHPRLARGESYTCGYKPFRCEVCNYSTTTKGNLSIHMQSDKHLNNMQNLQNGGGEQVFSHSAGAAAAAAAAAAAAANIGSSWGAPSPTKPKTKPTWRCEVCDYETNVARNLRIHMTSEKHMHNMMLLQQNMTQIQHNRHLGLGSLPSPAEAELYQYYLAQNMNLPNLKMDSTASDAQFMMSGFQLDPTGPMAAMTPALVGGEIPLDMRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEPVEDAEGPSEASADPEELAKDQGSGSEEGQSKRAASSSQAEKELTDSPATTKRTSFPGSSETPLSSKRPKASEEIKPEQMYQCPYCKYSNADVNRLRVHAMTQHSVQPLLRCPLCQDMLNNKIHLQLHLTHLHSVAPDCVEKLIMTVTAPEMVMPSSMFLPAAAADRDGNSTLEEVGKQPEASEDPGKNILPPASMEHGGDLKPTSADPSCGREDSGFLCWKKGCNQVFKTSATLQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGNSNGTGNSGGVSLSSSTPSPVGSSGANNTFTATNPSSAAMAPSVNALSQVPPESVVMPPLGNPISANIASPSEPKEANRKKLADMIASRQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGSGPGLLEDLKVQVQIPQQSHQQILQQQQQQSQLSLSQSHSALLQPSQHPEKKNKVVIKEKDKESQREREGPEGAEGNTGPQESLPDASKAKEKKDLAPGGGSEGTMLPPRIASDARGNATKALLENFGFELVIQYNENKQKAQKKNGKAEQGGESLEKLECDSCGKLFSNILILKSHQEHVHQNYFPFKQLERFAKQYREHYDKLYPLRPQTPEPPPPPPPPPPPPLPTAPPQPASAPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPQKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSTPAPSAAAANTAPSAFLQLTAETDELATFNSKAEASDEKPKQADPPSAQPNQTQEKQGQPKPEMQQQLEQLEQKTNAPQPKLPQPAAPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSAPNEGLTKAAMMAMSEYEDRLSSGLVSPAPSFYSKEYDNEGTVDYSETSSLADPCSPSPGASGSAGKSGDGGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNAPLQALNLPTTYPALQGIPPVLLPGLNRPSLPGFTPANTALTSPKPNLMGLPSTTVPSPGLPTSGLPNKPSSASLSSPTPAQATMAMAPQPPPQPQQPQPPVQQPPPPPAAQQIPAPQLTPQQQRKDKDGEKGKEKEKAHKGKGEPLPVPKKEKGEAPPAGTGTISAPLPAMEYAVDPAQLQALQAALTSDPTALLTSQFLPYFVPGFSPYYAPQIPGALQSGYLQPMYGMEGLFPYSPALSRPLMGLSPGSLLQQYQQYQQSLQEAIQQQQQQQQQQQQQQQQQQRQLQQQQQQQQQKVQQQQQQQQQPKASQTPVPQGAASPDKDPAKESPKPEEQKNVPRELSPLLPKPPEEPEAESKSASADSLCDPFIVPKVQYKLVCRKCQAGFGDEEAARSHLKSLCCFGQSVVNLQEMVLHVPTGSGGGGGGGGGSGGGGGSYHCLACESALCGEEALSQHLESALHKHRTITRAARNAKEHPSLLPHSACFPDPSTASTSQSAAHSNDSPPPPSAAPSSSASPHASRKSWPPVGSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 391 - protein, 510 aa, Macaca mulatta
MATGRGRILQQHWLGLQTLRGPSRGGGAARGRARTFGFRKGPGVKCSAGSAAPRCHARGGRHWESSFSCCSGVLDGMPSEILLKIFSYLDAVSLLCAGCVSRRFYHLANDNFIWIRIYSTAFSPTRSNWKVNSVEKIAVSVSFLSVQDKEAGYWKKEYITKQIASVKAALADILKPVNPYTGLPVKTKEALRMFGLGWAIILKEKSGKEYIMEHVDLSVNDTSVTVIWYGKNWPCLASLSTLDLCGVTPVFMDWYKTPTKHRLRWHSLIAKYNLSHLTVSTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKKGNIENGHVKLIVIHLKNNREHLPLIGKVGLSWKTDILDGCIKSCSMMDVTLLDEHGKPFWCFSSPVCMRSPATPADGPSFLGQTYSVDYVDAEGRVHVELVWIRETEEYLIVNLVLYLSVAKINRWFGTEY

SEQ ID NO: 392 - protein, 3569 aa, Canis familiaris
MWPRLAFCCWGLALVSGWATFQQLSPSRNFSFRLFPEAAPGAPGRLSVQPAPAEDAAGRRVERLGQAFRRRVRRLRELSGRLELVFLVDESSSVGQANFLSELRFVRKLLSDFPVVPTATRVAIVTFSSKNNVVPRVDYISHRRAHQHKCALLRREIPAIAYRGGGTYTKGAFQQAAQILRHSRENSTKVIFLITDGYSNGGDPRPVAASLRDFGVEIFTFGIWQGNIRELNDMASTPKEEHCYLLHSFEEFEALARRALHEDLPSGSFIQEDMSHCSYLCEAGKECCDRMASCKCGTHTGQFECVCEKGYYGKGLQYECTACPSGTYKPEGSPGGLSTCLPCPDENHTSPPGSTSPEDCVCKEGYRASGQTCEVVHCPALKPPENGYFIQNTCNNHFNAACGVRCHPGFDLVGSSILLCLPNGLWSGSESSCRVRTCPHLRQPKHGRISCSTGEMSYRTMCLVTCDDGYRLEGSAKLTCQANAQWDGLEPRCVERYCSTFQKPRGVIISPPSCGKQPARPGTICQLSCRQGFILSGVREEVRCTTSGKWSAKVQMAVCKDVEAPQISCPKDIEAKTQEQQDSANITWQIPTAKDNSGEKVSIHVHPAFTPPYLFPIGDVAITYTAIDLSNNQASCTFHVKVIDVEPPSIDWCRSPPPMQVSEKEHSATWDEPQFSDNSGAVLLITRSHSPGELFPHGETIVRYTATDPSGNNRSCDIHIVIKGSPCEVPFTPVNGDFICTQDSAGVNCTLSCLEGYDFTEGSTEKYYCAYEDGIWNPPYSTEWPDCAIKRFANHGFKSFEMLYKATRCDDTDLLKKFSEAFETTLGKMVPSFCSDADDIDCRLEDLTKKYCLEYNYDYENGFAIGPGGWGAANRLDYSYDDFLDSVQETPTGAGKARSSRIKRNAPLSDHKIKLIFNITASVPLPDERNDTLELENQQRLIKTLETITNQLKRTLSQEPMYSFQLASEMLVADSNSLETEKAFLFCRPGSVLRGRMCVNCPLGTYYSLEHSACESCLIGYYQDEEGQLECKLCPAGTYTEYLHSRSSSECKAKCKPGTYSSNGLETCESCPLGSYQPAFGSQSCLLCPENTSSVKRGAVDISACGVPCPVGEFSRSGLMPCHPCPKDYYQPDPGKSFCLSCPFYGTTATSGTRSITDCSSFSSTFSAAEESVVPRASPGHIKKKYETSSQVFHECFLNPCHNSGTCQQLGRGYVCLCPSGYTGLKCEIDIDECSSLPCFNNGICKDLVGEFICECPSGYTGQLCEENINECNSSPCLNKGTCTDGLAGYHCTCVKGYTGLHCETEVNECQSSPCLNNAVCEDQVGGFLCKCPPGFLGTRCEKNLDECLSQPCKNGATCKDGANSFRCQCAAGFTGPHCEVNINECQSNPCRNQATCVDELNSYSCKCQPGFSGSRCETDQSSGFNLDFEVSGTYGYVMLDGVLPSLWAITCTFWMKSSDINNYGTPISYALENGSDNTFLLTDYNGWVLYVNGKEKITDCPSVNDGHWHHIAITWTSTDGAWKVYIDGKLSDGGLGLSVGSAIPGGGALVLGQEQDQKGEGFNPAESFVGSISQLNLWDYVLSPQQVKSLATSCPEELKKGNVLAWPDFLSGIMGKVKINYKSIFCSDCPPLEGLIPHLRTTSVDLKPGSKISLFCDPGFQMVGNPVQYCLNQGQWTQPLPHCERISCGVPPPLENGFYSAEDFHAGSTVTYQCNNGYYLLGDSRMFCTDNGSWNGISPSCLDVDECAVGSDCSEYASCLNTNGSYICSCIPPYTGDGKNCAEPIKCKAPGNPENGYSSGEIYTLGAKVTFSCKEGYQLVGATKITCLESGEWSDLLPYCEAVFCGVPAIPENGDIDVSSFTYGSKVTYRCNKGYTLNGAKESSCLASGSWSHSLPVCELVKCSSPESINNGKYILSGLTYLSTASYSCESGYSLQGPSVIECSASGSWDRAPPTCHLVVCGEPPAIKDAVITGRNFTFGNTVTYTCKEGYTLAGPDTIECLANGKWNGSNQQCLAVSCDEPPNVEHASPETAHRLFGDIAFYYCSDGYSLADNSQLLCNAQGKWVPPEGQAMPHCIAHFCEKPPSVSYSILESVSKAKFAAGSVVSFKCMEGFVLNTSAKIECLKGGQWNPSPMSIQCIPVRCGEPPSIMNGYASGTNYSFGAMVAYSCNKGFYIKGEKKSTCEATGQWSSPTPTCHPVSCNEPPKVENGFLEHTTGRIFESEVRYQCNPGYKSVGSPVFVCQANRHWHSESPLSCVPLNCGKPPPIQNGYMKGENFEVGSKVQFFCNEGFELIGDNSWTCQKSGKWNKKLNQKCVPAKCPEPPLLENQLVLKELATEVGVVTLSCKEGHALQGPSVLKCLPSQQWNDSFPVCKMVLCLPPPLISFGVPAPSSALHFGSTVKYSCVDGFFLRGDPTTSCQADGTWSSPLPECVPVECPHPEEILNGIIDVQGLAYLSTALYTCKPGFELVGNTTILCGENGQWLGGKPTCKPVECPKPREISNGKFSYTHLHYGQTITYSCRRGFRLEGPKALTCLETGDWDMDVPSCSAIHCNPPQPIENGFVEGADYGYGAMIIYSCFPGWQVAGHAMQTCGESGWSSAIPKCVPVDCGLPPHIDFGECTKVKDGQGHVDQEEDMMEIPYLTPRPPHHMAAVATWENTKGSPATHSANFPYGTIVSYTCNPGYELLGSPMLICQEDGTWNGSAPSCISIECDLPVAPENGFLHFTETTMGNAVQYICKPGHILLGSDMRFCLQNREWSGTSPRCEAISCPKPNPIMNGSVKGSNYTYLSVLYYQCNPGYVLNGPERRTCQQNNKWDESEPTCSPVDCGSPPISANGQVKGNQYTFQKEIEYTCNVGFFLEGDRSRVCLADGHWSGTTPICVPVRCVTPPQVANGVMDGLDYGFGKEVVFHCQDGYMLHGAPKLTCQSDGNWDAEFPSCKPVNCGPPEDPPHGFPNGFSFYHGGHIQYQCFPGYKLYGSPSRRCLSDGSWSGSPPSCLPCRCSTPVIQNGAVNGTDFGCGKVAQIQCFKGFKLHGVSEITCEANDQWSSGFPRCEHTSCGSPPVIPNAFISESGSLEENVITYNCRSGYVIQGSSDLVCTEKGTWSQPYPACEPLSCGSPPSVANAVATGEAHVYESKVKLRCLEGYVMDTDIDTFTCQKDGRWFPERISCSPKKCPLPANIAHILVQGDDFSVNKQVSVSCAEGYIYEGVNISTCQLDGTWEPPFSDESCSPVSCGKPESPEHGFVFGSKYSFESTVIYQCETGYELQGNKERVCQKNRRWSGEVATCKKTRCEAPLGFLNGKAEVENTTAGLRVVYSCNRGYSLEGAPEIHCTGHGVWSHPHPLCKPNPCPVPFVIPENAVLSEKEFYVDQNVSIKCREGFLLQGWGIITCNPDETWTVTNAKCEKISCGPPTHVGNAIARGIHYQYGDMITYSCYSGYMLEGSLRSICLENGTWTSPPICRAVCRFPCQNGGICQRPNACSCPDGWMGRLCEEPICILPCLNGGRCVAPYQCDCPPGWTGSRCHTAVCQSPCLNGGKCVRPNRCHCVSAWTGHDCSRKRRTGF

SEQ ID NO: 393 - protein, 1055 aa, Strongylocentrotus purpuratus
MVDWNEFVTYMLLHYRENDNMKLRKNVVFNKEPKIRHIAQNKQDIVWCTIVLENPCRYVTLSKEGTLCLFDENLRLENCLEIKDGMEDSRNGSKRRFKTWYSDIVYMANVNMLAVGSNSRTIRFWDIVNAKTCFEQFNLYALSDIPSCLDYWYDKKNPSGESLLVVGTDKGSINLFYFLKPQEKIFETPFKPEDTVQKIWMHHHKYVRHVVLPNVHAEDIRKVRYLPDKDFILSSSGCRKTPLIMMDIQGKKKSYTYKLSKGVECFDYNRTMNVIATGGIDHVVRLWNPYVQDKPIAFLRGHTMAVVGVVINERFKHVYSFAKDGVVKIWDLYEYTCLQTVSGRQLMAACADYIALLSLGRNNALERRTPVTHETQLCCTVYNSFFKMVATAADDSSISIWNVETGAKSFTIPEAHGNEEITCLTISTTGRKLYSGARNGTIKVWSFQNGHSIHECESVGDDEITGLISVGKKKGFLSVGWSRKIVQYQDGDCDTSFLKADTNWKGGQVHKDDILAFDYSPPSLLATASFDGEILIWSLETQKISVRLRRGQPTIISQKLKAVLSMLGVNPFAIKKKSNDMDLTSEERSKVRSRPNSRHRRTHKQPEGFSQAPVEKLLFLASRLSGGMSDSAVLVSSEAGHLHFWAIYGQKRHHRGSFYSSDSAKEEESVLALSTNADNSLLITGDTMGHVYIWGIANHCIYATNVEDNSRPPLIKSWKAHDATVVSVEYINHSCGQFILTASTDFTARLWTIEGHFVGTFGQTMNWDLMNPNTYEHPNDPWTDDQPPPQEKDILSEGGSSDEEDDDVFDDDDVKVEDITLPPEDTAGNTELTKANLAMLPGSKPIPLSRRSSAGSGGRAGKSSSSENSRKSGGHSLLDMNLNSNLVGNANATGHTSSPILVPVIKPQASSRLDSVTSPSNGKKEIGSMPAIAKLLVSASAPEPKTGFFATQRDQSTLSSTSRVTRSSDNAAPAGPQSHTANPLPPISKSLGALSEEAEGAGGDESKVGTRKKSNNDVMVRHSGQSVQSEDSLLFDTHKKAFGIVLSYLTTYSKY

SEQ ID NO: 394 - protein, 1861 aa, Homo sapiens
MLKAVLKKSREGGKGGKKEAGSDFGPETSPVLHLDHSADSPVSSLPTAEDTYRVSLAKGVSMSLPSSPLLPRQSHLVQSRVNKKSPGPVRKPKYVESPRVPGDAVIMPFREVAKPTEPDEHEAKADNEPSCSPAAQELLTRLGFLLGEGIPSATHITIEDKNETMCTALSQGISPCSTLTSSTASPSTDSPCSTLNSCVSKTAANKSPCETISSPSSTLESKDSGIIATITSSSENDDRSGSSLEWNKDGSLRLGVQKGVLHDRRADNCSPVAEEETTGSAESTLPKAESSAGDGPVPYSQGSSSLIMPRPNSVAATSSTKLEDLSYLDGQRNAPLRTSIRLPWHNTAGGRAQEVKARFAPYKPQDILLKPLLFEVPSITTDSVFVGRDWLFHQIEENLRNTELAENRGAVVVGNVGFGKTAIISKLVALSCHGSRMRQIASNSPGSSPKTSDPTQDLHFTPLLSPSSSTSASSTAKTPLGSISAENQRPREDAVKYLASKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 395 - protein, 1068 aa, Homo sapiens
MSNKTGGKRPATTNSDIPNHNMVSEVPPERPSVRATRTARKAVAFGKRSHSMKRNPNAPVTKAGWLFKQASSGVKQWNKRWFVLVDRCLFYYKDEKEESILGSIPLLSFRVAAVQPSDNISRKHTFKVTVCWVDEAEASSTRCLSPQAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKVGVVPPRTKSPTDDEVTPSAVVRRNASGLTNGLSSQERPKSAVFPGEGKVKMSVEEQIDRMRRHQSGSMREKRRSLQLPASPAPDPSPRPAYKVVRRHRSIHEVDISNLEAALRAEEPGGHAYETPREEIARLRKMELEPQHYDVDINKELSTPDKVLIPERYIDLEPDTPLSPEELKEKQKKVERIKTLIAKSSMQNVVPIGEGDSVDVPQDSESQLQEQEKRIEISCALATEASRRGRMLSVQCATPSPPTSPASPAPPANPLSSESPRGADSSYTMRV

SEQ ID NO: 396 - protein, 1505 aa, Macaca mulatta
MHSNKDCSNACKEGPKLTAFLLKTGIFLRHLVAIKQLAHVKVDRFFPRRQSLAESRTAGIGLQTNFPLFLNSISSARPPTVLRQPFPSVTSFSSCTTRRRPFSQPQSSRVALAALPPGPRPAFSTTARSPPHRPAPPSDSQWRRDPAPPAVPWELAGSGRRGTPNSLCIFFWAAAIQRPLAPRPSLGAAMDSQELKTLINYYCQERYFHHVLLVASEGIKRYGSDPVFRFYHAYGTLMEGKTQEALREFEAIKNKQDVSLCSLIALIYAHKMSPNPDREAILESDARVKEQRKGAGEKALYHAGLFLWHIGRHDKAREYIDRMIKMSDGSKQGHVLKAWLDITRGKDPYTKKALKYFEEGLQDGNDTFALLGKAQCLEMRQNYSGALETVNQIIVNFPSFLPSFVKKMKLQLALQDWDQTVETAQWLLLQDSQNVEALRMQALYYVCREGDIEKASTKLENLGNALDAMEPQNAQLFYNITLAFSRTCGRSQLILQKIQTLLEKAFSLNPQQSEFATELGYQMILQGRVKEALKWYKTAMTLDETSVSALVGFIQCQLIEGQLQDADQQLEFLNEIQQSIGKSAELIYLHAVLAMKKNKRQEEVINLLNDVLDTHFSQIEGLPLGIQYFEKLNPDFLLEIVTEYLSFCPMQPASPGQPLCPLLRRCVSVLETVVRTVPGLLQTVFLIAKVKYLSGDIEAAFNNLQHCLEHNPSYADAHLLLAQVYLSQEKVKLCSQSLELCLSYDFKVREYPLYHLIKAQSQKKMGEIADAIKTLHMAMSLPGMKRIGASTKSKDRKTEVDTSHRLSIFLELIELHRLNGEQHEAAKVLQDAIHEFSGTSEEVRVAIANADLALAQGDIERALSILQNVTAEQPYFIEAREKMADIYLKHRKDKMLYITCFREIAERMANPRSFLLLGDAYMNILEPEEAIVAYEQALNQNPKDGTLASKMGKALIKTHNYSMAITYYETALKSGQKNYLCYDLAELLLKLKWYDKAEKVLQHALAHEPVNELSALMEDGRCQVLLAKVYSKMERPGDAITALQQARELQARVLKRVLMEQPDAVPAQKHLAAEICAEIAKHSVAQRDYEKAIKFYREALVHYETDNKIMLELARLYLAQDDPDSCLRQCALLLQSDQDNEAATMMMADLMFRKQDYEQAVFHLQQLLERKPDNYMTLSRLIDLLRRCGKLEDVPRFFSMAEKRNSRAKLEPGFQYCKGLYLWYTGEPNDALRHFNKARKDRDWGQNALYNMIEICLNPDNETIGGEVFENLDGDLGNSTEKQESVQLAVRTAEKLLKELKPQTVQGHVQLRIMENYCLMATKQKSNVEQALNTFTEIAASEKDHIPALLGMATAYMILKQTPRARNQLKRIAKMNWNAIDAEEFEKSWLLLADIYIQSAKYDMAEELLKRCLRHNRSCCKAYEYMGYIMEKEQAYTDAALNYEMAWKYSNRTNPAVGYKLAFNYLKAKRYVDSIDICHQVLEAHPTYPKIRKDILDKARASLRP

SEQ ID NO: 397 - protein, 3509 aa, Canis familiaris
MNMVKRIMGRPRQEECSPQDNALGLMHLRRLFTELCHPPRHMTQKEQEEKLYMMLPVFNRVFGNAPPNTMTEKFSDLLQFTTQVSRLMVTEIRRRASNKSTEAASRAIVQFLEINQSEEASRGWMLLTTINLLASSGQKTVDCMTTMSVPSTLVKCLYLFFDLPHVPEAVGGAQNELPLAERRGLLQKVFVQILVKLCSFVSPAEELAQKDDLQLLFSAITSWCPPYNLPWRKSAGEVLMTISRHGLSVNVVKYIHEKECLSTCVQNMQQSDDLSPLEIVEMFAGLSCFLKDSSDVSQTLLDDFRIWQGYNFLCDLLLRLEQAKEAESKDALKDLVNLITSLTTYGVNELKPAGITTGAPFLLPGFAVPQPAGKGHSVRNIQAFAVLQNAFLKAKTNFLAQIILDAITNIYMADNANYFILESQHTLSQFAEKISKLPEVQSKYFEMLEFVVFSLNYIPCKELISVSILLKSSSSYHCSIIAMKTLLKFTRHDYIFKDVFREVGLLEVMVNLLHKYAALLKDPTQALNEQGDSRNNSSIEDQKHLALLVMETLTVLLQGSNTNAGIFREFGGARCAHNIVKYPQCRQHALMIIQQLVLSPNGEDDMGTLLGLMHSAPPTELQLKTDILRALLSVLRESHRSRTVFRKVGGFVYITSLLVAMERSLSSPPKNGWEKVNQNHVFELLHTVFCTLTAAMRYEPANSHFFKTEIQYEKLADAVRFLGCFSDLRKISPMNVFPSNTQPFQRLLEEDVISMDTVSPTLRHCSKLFIYLYKVATDSFDSRAEQIPPCLTSESSLPSPWGTPALSRKRHAYHSVSTPPVYPPKNIVDLKLHVATTSLQSSDAVIIHPGAMLAMLDLLASVGSVTQPEHALDLQLAVANILQSLVHTERNQQVMCEAGLHARLLQRCSAALADEDHSLHPPLQRMFERLASQALEPMVLREFLRLASPLNCGAWDKKLLKQYRVHKPSSLSYEPEMRSSLITSMEGLGSDNVFSLHEDNHYRISKSLVKSAEGSTVPLTRVKCLVSMTTPHDIRLHGSSVTPAFVEFDTSLEGFGCLFLPSLAPHNAPTNNAVTTGLTDGAVVSGIGSGERFFPPPSGLSYSSWFCIEHFSSPPNNHPVRLLTVVRRANSSEQHYVCLAIILSAKDRSLIVSTKEELLQNYVDDFSEESSFYEILPCCARFRCGELIVEGQWHHLVLVMSKGMLKNSTAALYIDGQLVNTVKLHYVHSTPGGSGSANPPVVSTVYAYVGTPPAQRQIASLVWRLGPTHFLEEVLPPSNVTTIYELGPNYVGSFQAVCMPCKDAKCEGVVPSPVSLVPEEKVSFGLYALSVSSLTVARIRKVYNKLDSKAIAKQLGISSHENATPVKLIHNSAGHLNGPARTVGATLIGYLGVRTFVPKPVATTLQYIGGAAAILGLVAMASDVEGLYAAVKALVCVVKSNPLASKEMERIKGYQLLAMLLKKKRSLLNSHILHLTFSLVGTVDSGHETSIIPNSTAFQDLLCDFEVWLHAPYELHLSLFEHFIELLTESSEASKNAKLMREFQLIPKLLLTLRDMSLSQPTIAAISNVLSFLLQGFPNSNDLLRFGQFISSTLPTFAVCEKFVVMEINNEEKLDTGTEEEFGGLVSANLILLRNRLLDILLKLVYTSKEKTSINLQACEELVKTLGFDWIMMFMEEHLHSTTVTAAMRILVVLLSNQSILIKFKEGLSGGGWLEQTDSVLTNKIGTVLGFNVGRSAGGRSTVREINRDACHFPGFPVLQSFLPKHTNVPALYFLLMALFLQQPVSELPENLQVSVPVISSRCKQGCQFDLDSIWTFIFGVPASSGTVVSSIHNVCTEAAFLLLGMLRSMLNSPWQSEEEGSWLREYPVTLMQFFRYLYHNVPDLASMWMSPDFLCALAATVFPFNIRPYSEMVTDLDDEVGSPAEEFKAFAADTGMNRSQSEYCNVGTKTYLTNHPAKKFVFDFMRVLIIDNLCLTPASKQTPLIDLLLEASPERSTRTQQKEFQTYILDSVMDHLLAADVLLGEDASLPITSGGSYQVLVNNVFYFTQRVVDKLWQGMFNKESKLLIDFIIQLIAQSKRRSQGLSLDAVYHCLNRTILYQFSRAHKTVPQQVALLDSLRVLTVNRNLILGPGNHDQEFISCLAHCLINLHVGSNVDGFGLEAEARMTTWHIMIPSDIEPDGGYSQDISEGRQLLIKAVNRVWTELIHSKKQALEELFKVTLPVNERGHVDIAIARPLIEEAGLKCWQNHLAHEKKCISRGEALVPTTQSKLSRVSSGFGLSKLTGSRRNRKESGLNKHSLSTQEISQWMFTHIAVVRDLVDTQYKEYQERQQNALKYVTEEWCQIEYELLRERGLWGPPIGSHLDKWMLEMTEGPCRMRKKMVRNDMFYNHYPYVPETEQETNVAKPARYRRAISYDSKEYYMRLASGNPAIVQDAIVESSEGEAAQQEPEHGEDTIAKVKGLVKPPLKRSRSAPDGGDEESQEQLQDQIAEGSSIEEEEKTDNATLLRLLEEGEKIQHMYRCARVQGLDTSEGLLLFGKEHFYVIDGFTMTATREIRDIETLPPNMHEPIIPRGARQGPSQLKRTCSIFAYEDIKEVHKRRYLLQPIAVEVFSGDGRNYLLAFQKGIRNKVYQRFLAVVPSLTDSSESVSGQRPNTSVEQGSGLLSTLVGEKSVTQRWERGEISNFQYLMHLNTLAGRSYNDLMQYPVFPWILADYDSEEVDLTNPKTFRNLAKPMGAQTDERLAQYKKRYKDWEDPNGETPAYHYGTHYSSAMIVASYLVRMEPFTQIFLRLQGGHFDLADRMFHSVREAWYSASKHNMADVKELIPEFFYLPEFLFNSNNFDLGCKQNGTKLGDVILPPWAKGDPREFIRVHREALECDYVSAHLHEWIDLIFGYKQQGPAAVEAVNVFHHLFYEGQVDIYNINDPLKETATIGFINNFGQIPKQLFKKPHPPKRVRSRLNGDSMGASAPPGSSSDKIFFHHLDNLRPSLTPVKELKEPVGQIVCTDKGILAVEQNKVLIPPTWNKTFAWGYADLSCRLGTYESDKVVTIYECLSEWGQILCAICPNPKLVITGGTSTVVCVWEMGTSKEKAKTLTLKQALLGHTDTVTCATASLAYHIIVSGSRDRTCIIWDLNKLSFLTQLRGHRAPVSALCINELTGDIVSCAGTYIHVWSINGNPIVSVNTFTGRSQQIVCCCVSEMNEWDTQNVIVTGHSDGVVRFWRMEFLQVPETPAPEPVEVLEMQEDCPEAQIGQEAQDEDSSDSEADEQSTSQDPKDVPSQPSSTSHRPRAASCRAAAVWCTDSGSDDSRRWSDQLSLDEKDGFIFVNYSEGQTRAHLQGPLNHPHPSPIEVRNYSRLKPGYRWERQLVFRSKLTMHTAFDRKDNAHPAEITALGVSKDHSRILVGDSRGRVFSWSVSDQPGRSAADHWVKDEGGDSCSGCSVRFSLTERRHHCRNCGQLFCQKCSRFQSEIKRLKISSPVRVCQNCYYNLQHERGSEDGPRNC

SEQ ID NO: 398 - protein, 740 aa, Macaca mulatta
MEADGDGEQLARLRSVFAACDANRSGRLEREEFGSLCAELRVRPADAEAVFQRLDADHDGAITFQEFARGFRGALRGGRRQDWGLLGPALAVAEAGPETPDSEEDEGDEDAEAALATSWGPASPDPAWQDFQARLGEEAKFIPREEQVSTLYQNINLVEPRLIQPYEHVIKNFIREIRLQSTEMENLAIAVKRAQDKAAMQLSELEEEMDQRIQAAEHQTRKDEKRKAEEALSDLRRQYETEVGDLQVTIKKLRKLEEQSKHISQKEDVAALKKQIYDLSMENQKVKKELLEAQTNIAFLQSELDALKSDYADQSLNTERDLEIIRGYTEDRNSLERQIEILQTANRKLHDSNDGLRSALENSYSKFNRSLRINNISPGNTISRSSPKFTGHSPQPLGYDRSSRSSYVDEDCDSLALCDPLQRTNCEVDSLPESCFDSGLSTLRDPNEYDSEVEYKHQRGFQRSHGVQESFGGDASDTDVPDIRDEETFGLEDVASISDWKLQGTVSEGSIVSSSRKPISALSPQTDLVDDNAKSFSSQKAYKIVLAGDAAVGKSSFLMRLCKNEFRENISATLGVDFQMKTLIVDGERTVLQLWDTAGQERFRSIAKSYFRKADGVLLLYDVTCEKSFLNIREWVDMIEDAAHETVPIMLVGNKADIRDTAAAEGQKCVPGHFGEKLAMTYGALFCETSAKDGSNIVEAVLHLAREVKKRTDKDDSKSITNLTGTNSKKSPQMKNCCNG

SEQ ID NO: 399 - protein, 387 aa, Xenopus tropicalis
LYLVQGFPYGLQSGLLPVLLRTKGLSLSHIGLTRILYLPWLLKVLWSPLIDRQWSRRTWLLLSTGGLSLCCLLCSMLPPGADFSLLAWLLLLMHVLSSLQDVVVDAVAVAALTQEQVGLGNSLQVVAYKLGSVIAGGGALTVLELLGWRQVFLLLTLGYLLGALCALSSTAILRPNPQQPKVHKQPSEGATLGDLAVKVFRVPGTSWAAAFVLIYKLGEQGSLSMVPLLLLDHGVSPAKLGFWNGIVSLGLSIAGSALGGALLSRGSQPDVLDRLRPCSRCQEFAPCSCGGNVGFGVDLVLLTVVAQHFLAGVVTTVTFSLMMYCTQQAEHHVQAAHYSLLSSAEVLGKVFFGAVSGIVVDCLGVSVSFCLFIALSCAPLLHLHKPP

SEQ ID NO: 400 - protein, 111 aa, Xenopus tropicalis
VNIITHNAKGLNIPQKRKQALRYYKACKGDIIMVQETHFKTGQTPKWWDTTFPNIYHATHAGKKNGVSILIHRNLNFQVQESITDKEGCYLFLKGTLNTKECLLGNIYAPS

SEQ ID NO: 401 - protein, 564 aa, Homo sapiens
MDSHSGEPALLPCGTCDMVFRSSALLATHTQRFCIGHPTQEMTFGAQASVATEPQRAAVQWLRLSLQEMRPWITEVPRVFAGPWTRSEARPQSPMSEAVGSPSERLRALFRTRARRVAEMEAQSRALQLRGEELSRRLQVVACTRGGMSRLFGLEQEIRELQAEAGRTRGALEVLGARIQELQAEPGNPLSSRREAELYSPVQKANPGTLAAEIRALREAYIRDGGRDPGVLGQIWQLQVEASALELQRSQTRRGRAGATSGELPVVEAENRRLEAEILALQMQRGRAPLGPQDLRLLGDASLQPKGRRDPPLLPPPVAPPLPPLPGFSEPQLPGTMTRNLGLDSHFLLPTSDMLGPAPYDPGAGLVIFYDFLRGLEASWIWVQLRTGLARDGRDTGRTTALPPALCLPPPPAPGPMGNCAILASRQPVPRLPPSSSVSLVCELQVWQGLAWARAPQPKAWVSLGLFDQDQRVLSGRWRLPLRALPLDPSLSLGQLNGIPQAGQAELFLRLVNARDAAVQTLAEINPASVHEYQYPPPVRAQLQLGTPQLHIPVWLVWLTASLY

SEQ ID NO: 402 - protein, 629 aa, Homo sapiens
MAISPRSDATFSSQKSTPSESPRTKKFPLTEEEIFYMNCRAAYLTVFKSSLENIISKDQLYLALQHAGRNPSQKTINKYWTPQTAKLNFDDFCIILRKEKPTSKAELLKSFKQLDVNDDGCILHTDLYKFLTKRGEKMTREEVNAIINLADVNADGKFDYIKFCKLYMTTNEQCLKTTLEKLEVDSKLMRHQFGNHIEGSPERDPSPVPKPSPKITRKTDPETFLNKGDTRSSLLSATRKFKTSVSFIVTMGANGNRNSKLTEPNLIKDWQHMQSKGCFFLEEDGEIISHQYRMQIAQRSMVYLTIKPLNLSQVEGKPSPWLSVDTALYILKENESQANLQLVCFTELRNREVFGWTGELGPGIYWLIPSTTGCKLRKKIKPVTDEAQLVYRDETGELFLTKEFKSTLSDIFEVIDLDGNGLLSLEEYNFFELRTSGEKCDEDAWAVCRENFDTKRNELTRQGFMDLNLMEANDREGDPCDLWVTLHSMGYNKALELTEACPFVIDIYAEKCKPKIKAVHMEACSGQLEKAICKSVLSNGDAKVMDGYENIIVHTYSCDTWITSVIENKSDEKVIIHISNELSKNCINNRGLNIFAVEVGPKSTMVCQHVMPLNERQEWIYYCIYSLIS

SEQ ID NO: 403 - protein, 514 aa, Homo sapiens
MGCDGRVSGLLRRNLQPTLTYWSVFFSFGLCIAFLGPTLLDLRCQTHSSLPQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMAIINLPVPMAVLMLLSKERLLTCCPQRRPLLLSADELALETQPPEKEDASSLPPKFQSHLGHEDLFSCCQRKNLRGAPYSFFAIHITAALVLFMTDGLTGAYSAFVYSYAVEKPLSVGHKVAGYLPSLFWGFITLGRLLSIPISSRMKPATMVFINVVGVVVTFLVLLIFSYNVVFLFVGTASLGLFLSSTFPSMLAYTEDSLQYKGCATTVLVTGAGVGEMVLQMLVGSIFQAQGSYSFLVCGVIFGCLAFTFYILLLFFHRMHPGLPSVPTQDRSIGMENSECYQR

SEQ ID NO: 404 - protein, 315 aa, Xenopus tropicalis
MPNQNWQTIKKEMSQKKQCATGFFCCWILTPMQGEVLPVFAPDTRLDSGGCARKRAAMSVTLTAVKRVQSSPNLLASGQDSHPLDSDIWRSYNDSLKDGLNDDSGGSSFTAKGFRSVRPNLQEKKSPTQGDDNENSAPTMLTQSGVQSLTNRESFLYSAKQSKNMMQTHTTTNPHISFSKLNMKAEDTNSMLIHHDSSQDSKHRRVSTLKLILKESPTNKTQSNMHFIKDSAPLVPAPPPTIIPEARRQSPEKHTASLSVSIASNLATKAEDKPESHRCSTVHSTDTFKVPAACYSGHAAAFPSATWSTESQVVY

SEQ ID NO: 405 - protein, 298 aa, Homo sapiens
MRDPLRPPQGGDAAQGPRALTSTRKTGLDEGSCGLSANGSRHPSPGWRRGTGLQVLTQQAFAFSANGSRHPSPGQHQGTGLQVLTQQAFAFSANRSRHPSPGQRRGTGLQVLTQQAFAFSANGSRHPSPGQHRGTGLQVLTQQAFAFSANRSRHPSPGQRRGTGLQVLTQQAFAFSANGSRHPSPGQRRGTGLQVLNQQAFAFSANGSRHPSPGQHRGTGLQVLTQQAFAFSANGSRHPSPGQRRGTGLQVLNQQEFAFSANGSRHPSPGQCQGTGLQVLSTTGSARTENQPLWRSFS

SEQ ID NO: 406 - protein, 114 aa, Xenopus tropicalis
MARENGENSGTSWKKQVEDVKRIFQFKEVLGTPHPLLVIPTVGTPTLDNRYIFLSIYCPNKNVNIDSYQCGMDITKVGTTMGTLMKKQHATFLQAKRTFSLHLQLPHPHWITGL

SEQ ID NO: 407 - protein, 280 aa, Homo sapiens
MNDRSSRRRTMKDDETFEISIPFDEAPHLDPQIFYSLSPSRRNFEEPPEAASSALALMNSVKTQLHMALERNSWLQKRIEDLEEERDFLRCQLDKFISSARMEAEDHCRMKPGPRRMEGDSRGGAGGEASDPESAASSLSGASEEGSASERRRQKQKGGASRRRFGKPKARERQRVKDADGVLCRYKKILGTFQKLKSMSRAFEHHRVDRNTVALTTPIAELLIVAPEKLAEVGEFDPSKERLLEYSRRCFLALDDETLKKVQALKKSKLLLPITYRFKR

SEQ ID NO: 408 - protein, 551 aa, Homo sapiens
MAKLEKMYQDKLHLKEVQPVVIREDSLSDSSRSVSEKNSYHPVSLMTSFSEPDLGQSSSLYVSSSEEELPNLEKEYPRKNRMMTYAKELINNMWTDFCVEDYIRCKDTGFHAAEKRRKKRKEWVPTITVPEPFQMMIREQKKKEESMKSKSDIEMVHKALKKQEEDPEYKKKFRANPVPASVFLPLYHDLVKQKEERRRSLKEKSKEALLASQKPFKFIAREEQKRAAREKQLRDFLKYKKKTNRFKARPIPRSTYGSTTNDKLKEEELYRNLRTQLRAQEHLQNSSPLPCRSACGCRNPRCPEQAVKLKCKHKVRCPTPDFEDLPERYQKHLSEHKSPKLLTVCKPFDLHASPHASIKREKILADIEADEENLKETRWPYLSPRRKSPVRCAGVNPVPCNCNPPVPTVSSRGREQAVRKSEKERMREYQRELEEREEKLKKRPLLFERVAQKNARMAAEKHYSNTLKALGISDEFVSKKGQSGKVLEYFNNQETKSVTEDKESFNEEEKIEERENGEENYFIDTNSQDSYKEKDEANEESEEEKSVEESH

SEQ ID NO: 409 - protein, 411 aa, Homo sapiens
MAPESHILASNTMETHILASNTMDSQMLASNTMDSQMLASNTMDSQMLASSTMDSQMLATSSMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMA

SEQ ID NO: 410 - protein, 1437 aa, Xenopus tropicalis
MKIASEILRTHKVLHTWTGIISGLLLFIGFFAGALTLFEVPLERWANVAVERGASSWFESDDSLVSQVLARHPAARKAFTLDPSPQVGRRARMTWQGGEECPGELCAERWQAEVHADGAVEVEKLQKAQIGQLIDLLHRTAGVPGVIAEEHVGVYVMGVASILYFLAIVSGVILILPALVRDLFALRSGRNRKRFWLDAHNAVGIASLPFHIVISLTVIVFAFHDQFYDALSDVVYGKHPMFSPTPAAAEPYKVDALLPVTRLLDRAREEAPDFEIAELLYMNLESVRPLVRVALENSREVVHGPSAAYLIMHPYSGEVLNERMVPGRRNVWTATVDSFFALHVGSFGGSPVRWIYFVMGLGGAFLFYSGNLLWLESRRRRQRTADAPAVEQSRSVHYMAALTVGGCLGSIIGVALCLSAAKLGYTQQALSNDLLILMYYVTFLSAVSWALYRGAARASVDLLFSAGVAVLAMPISSVGALLITAGTTDSSLALLLSANLEHVAVDGAALLFAFIFIAAGKHTLHKVRHSSPDTICLNMVLGAPGDPPTQPELLFSSSFRSIRAQGIQAWVNTPALDGGAFQSAIEEALARARAAGQQDSIVMGAIPFDISQPSYLYVPKRYEYVSRDEVLAADHRGALCPRVVSARNIPDEQSFKMGVRQAIANFQHSCIRKAVLSRKCEIHLSEPLDMGCVLGNLVAQNPSAYHFRLPMEDGSELIGASPELLLRKEGARIQTFPLAGSARRQADPEADRQTADALQGSAKDHYEHRVVVDDIRQVLAPLCTQLQIPEVPELVSTATIPDRALRAGRFHWHRGLERHPWQWRVGGDHPLRHGQEILAVPVCRGWHRRSLLPGCGMGRNPGQAGHHAERHRVGAGGVRPMSIQFTSWPENLARHYREAGYWQDRPLTDILDHQAASRPDHLALICGQRQFSYRAMAARVECLVAALRRRGLVRHQTALVQLPNVAEFYLVYFALLRIGVVPVNALFSHQCYELSAYARQISPSLLIADTNHGLFGNEAFIRGLQTLTPGLGTVLLRGSADPALSLELAFEETPGRERHSNPTDPGEVAFFQLSGGSTGTPKLIPRTHNDYYYSIRRSVELCGIGPETRYLCALPAAHNYPLSSPGALGVFNGGGCVVLAPSPEASACFDLIERHQITMTSLVPSAVALWLQVAPGNRQRLSSLKLLQVGGASFAEAMARRVPVELGCKLQQVFGMAEGLVNYTRLDDPDERVFTTQGCPMSPVDEVRVLDAQGHPVPPGDTGILATRGPYTFRGYYRSPEYNQQAFDAEGFYHSGDLVQRGPDGYLRVVGRVKDQINRGGEKIAAEEIEVLLLRHPDVTHAGLVGMPDELLGEKSCAYIVSRDPNLNGMQLRKFLRAQGVADYKLPDRFQLIPQMPLTAVGKTDKTTLRAWAQSVQAIHEQAAPATHDTLPRTTSA

SEQ ID NO: 411 - protein, 443 aa, Xenopus tropicalis
MMEESGIETTPPSTPPPSTAGTSVAAATTAIATPIPPVLSSPLAAPAFSPLPSFAQPSFSTPVPSSVAPPRSSVPFTYASALPVTGVHSPPVNTSVPAAFSSPLPAFSSPSSFPPPPLNTTPGPVLSAPPMVPPVGGFSMSSTYDITKGHAGRAPQTPLMPTYSAAPVTVLPNPVTLQAPVAGSGSSITFPEEPEDPRVHTVHDEGSAGGIWGFIKGVAGNPMVKSVLDKTKHSVETVITTLDPGMASYIRTGGEMDIVVTSIKEVKVAAVRDAFQEVFGMAVVTGEDGQSNIAPQPVGYAAGLKGAQERIDSLRRSGMIHEKQPAVSVENFIAELLPDKWFDIGCVIVDDPVHGIRLEAFTQATPVPLEYVQQAQNFTPQDYNLRWSGLSVTVGEVLERSLAHVSRTDWHVAFTGMSRRQMIYSAAKALAGMYKQRLPPRIL

SEQ ID NO: 412 - protein, 1020 aa, Homo sapiens
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQVLVQGCLLDPSQREVFLQQIYEQLCLFEDKVATMLQQQYDPQSQAEDQSPDSGDLLGRKVGVSMVTADLGLVSMIRQGILALQLLPSNSSAGIIVITDGVTSVPDVAVCETLLNQLRSGTVACSFVQVGGVYSYDCSFGHVPNVELMKFIAMATFGSYLSTCPEPEPGNLGLTVYHRAFLLYSFLRSGEALNPEYYCGSQHRLFNEHLVSASSNPALALRRKKHTEKEVPADLVSTVSVRLREGYSVREVTLAKGGSQLEVKLVLLWKHNMRIEYVAMAPWPLEPEGPRVTRVEVTMEGGYDILHDVSCALRQPIRSLYRTHVIRRFWNTLQSINQTDQMLAHLQSFSSVPEHFTLPDSTKSGVPLFYIPPGSTTPVLSLQPSGSDSSHAQFAAYWKPVLSMDANSWQRWLHMHRLVLILEHDTPIPKHLHTPGSNGRYSTIQCRISHSSLTSLLRDWSSFVLVEGYSYVKLLSSAPDQPPNSFYMVRIISKAPCMVLRLGFPIGTPAPARHKIVSGLREEILRLRFPHRVQSKEPTPKVKRKGLGGAGGGSSPSKSPPVLGPQQALSDRPCLVVLHKPLDKLLIRYEKLPLDYRAPFLLTLEPPGPLPLVSGRSASSSLASLSRYLYHQRWLWSVPSGLAPALPLSAIAQLLSILTEVRLSEGFHFACSGEGIINMVLELPIQNEPPGQAAAEEKHTCVVQYILFPPHSTSTKDSFSTDDDNDVEVEALEGDSELNLVTEVWVEPQYGRVGPGPGIWKHLQDLTYSEIPQALHPRDAACIGSMLSFEYLIQLCQSKEWGPLPPEPRVSDGLDQGGDTCVHEIPFHFDLMGLLPQCQQLQMFFLLLARAAWGRS

SEQ ID NO: 413 - protein, 165 aa, Xenopus laevis
MSLILRNAQHAVPLYRAHLRFSLDIARSCLKVKNFDLGIICVNNARIQHINRVYRGQDSVTDVLSFPFHEDLNPSLLPIPATPDEYNLGDIYLGVAFIYEQCQKTQEDYRSILTITAVHGLCHLLGHKHNNPEKWKQMFEKETEILNEINRVTGSKLKPLSTNHY

SEQ ID NO: 414 - protein, 2458 aa, Canis familiaris
MPGTPLTQVTGSGGRIKMAAGEAAARAAGCSSCGAETMERVLPMLLVPVPVEATGRLGSRAQLHREQEVLGSLTAAGSLQVLSLAPGGRSGGACCLNGPFRHFIWEDSHNGSSPTDKPKLLALSENYELFIYEFNLKDGRCDATILYSCSEETLQKLIEDQNISVSFLSLRILSFHNNTSLLFINKCIVLHIIFPERDAEIRVLNCFTLPLPAQAVDRIIDVQLCRGILFVLSSLGWIYIFDIVDGRHVAHVDLALHQEDMCNEQQQELAKISSFTSLKVSQDLDVVVIVSSFNSAVALNLNLYFRQHPGHLLCERTLEDIPIEGPEGIDEDDPVNSDYNMKLTKFSFQVDRSWKAQLSSLNEIIKSSKWEVPCCAPWFQNILHLESPESGYHSTSTPGWAFIPQDEIHSHYKFPQKDHANTGDPGRSWKIMNISELKEPVELTCMSVTGFSVLFTWAVEKMGCTIVLWDLETQGIQCFSLGKRCIPIDMSGDQQLCLVLTENGLSLILFGLTQEEFLNRLMIHGSASTVDSLCHLNGWGRCSIPIHALEAGIENRQLDTVDFFLKSKENLLNPSSKSSVPDQFDDFPSHLYLRNVEKLTPALDLLCSAIRESDSETQSKHFSEQLLNLTLSFLNKQIKELFVHNEELDEHLQKGVNILTSYINELRTFMIKFPWKIVDPVDEYDVSENVLKVRESDTWEKLSIEEVIANAILNNKIPEAQTFFRINNHSAQRLEELIRIGLNLVFDCLKKNNIKEASELLKNMGFDVKDQLLKICFYTTDKNIRDFLVEILKEKNYFSENEKRTIDFVHQVEKFYSGHFQENVQIQSFTRYWIKEQDFFKHKSVLDSLLKYDPKDKFNKQDHRIVLNWAQWWNQLTQESILLPRISPEEYKSCSPEALWSYLTAHHDWSSISLWIEEFQAQNSCVLLQQNKWPLLTVDVIDQNTCCNNYMRNEILDQLARNGIFLQSELEDFELFLLRLNRIGGVMQDALPIQNYRSKEGWDFHSHFILYCLEHGLQYPLYVYLDFYKLSPANCPFLEKKELHETHPWFEFLVQCRQVSSNLTDPKLIFQASLANAQILIPSNQASVSSMLLEGHTLLALATTMYAPGGVSQVVQDDENETCLKKVDPQLLKMALTPYPKLKTALFPQYTTSNVLPPDITLYHLIQSLLPFDSSRLFGWQSANTLAIGDAVSHLPHFSSPDLVNKYAIMERLNFAYYLQHGRPSFAFGTFLVQELTKSKTPKQLIQQVGNEAYVLGLSSFYIPSVGAACVCFLELLGLDSLKLRVDMKVANIILNYKCRNEDVQYSCIREALVEKLSKLAVGEKATVEELLILLEEGIWNNIQQQEIKRLSSESSSQWALAVQFCRLHNVKLSTSYLRECAKANDWLQFIIHSQLYNYHPAEVKSLLQYFSPVLQDHLRLAFENLTSVSKSKMDSGEVCSRSPQELQRNKEEMADFFQVLLQCSEEPNPWCWLLAEAMKQQAPILSVLASCLQDASTIPCLCVWIITSVEDSVAAEATEHIQGSVEGHIWDLQDLSVIWRTLLTRQKNKTLIRGFQLFFKDSPLLLMMEMYELCMFFKNYKEAEAKLLEFQKSFETVETAATRVHTTIPAPWLREQVCFLLKLMLQQCGTQYELGKLLQLFVGIENFFSDGPDVKKLCVLSEILKDTSIAINHVIISSHSLENFQHECTSILEKLAMEGQFALARRVAELAELPVDNLVIEEMTQEMQTLKHIDQWSLKQARIDFWKKCHENFKKNSISSKAASSFFSAQAPECPTEEGRSSSEERHLLLTLAAHWLAQEDLVPVAELEELEKQIWLCRITQYTLREKQEQVELGFSQQISTSGELSFDGIASKFSLSMLAVLNTSKYLELSGFPSKETCDSGLDWKEQESLNFLIGHLLDDGFVHEASRVCRYFHFYNQDVALVLHCRALASGEASVDDLHPEIHALLQSAEPLEEEEAGIPLRKVQSSSSLDSQSFVMLPPSDEVVTNLETLTSKCLHGKNYCRQVLCLYELAKELGCSYTDVASQDGEAMLRAILASQQPDRCKRAQAFISTQGLEADTVAELVAEEVTRELLTPPEGTGHQQMFAPAEESRTFLQLTTLCQDRTLVGMKLLDKISSVPHGELSCTTELLILAHHCFTLTCHMEGIIRVLQAARLLTDKHLAPNEEYGLMVRLLTGIGRYNEMTYIFDLLHNKHYFEVLMRKKLDPSGSLKTALLDYIKRCRPGDSEKHNMIALCFSMCREIGENHEAAARIQLKLIESQPWEDSLKDGHHLKQLLLKALTLMLDAAESYAKDSCVRQAQHCHRLTKLITLQIHFLNTGQNTMLINLGRHRLMDCILALPRFYQASIVAEAYDFVPDWAEILYQQVILKGDFNYLEEFKQQRLLRSSIFEEISKKYKQHQPTDTAVKNLKKLLTYCEDVYLYYKLAYEHKFYDIVNVLLKDPQSGCCLKDMLAG

SEQ ID NO: 415 - protein, 812 aa, Homo sapiens
MGVHTPRPAPFHFVSLAGGSFKRWGRLVASKSCLSLWVINALGAGTLQSCLLRRFPKQGPRALTPVRRVAGGGGSLAECGWRRGRGSGRRDPTNWQPGGGPAEDRGGSDSPCTQSTVRRDLEQGPFPEGLAPEDVAPEPCDPLASAGGKPGAGTRVRPALGLNLRGCAAGEEPRRRRSAAVWEGDSFFLKLNIKLSFEVIFDDLFDGLVIGSFGRVYLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 416 - protein, 287 aa, Xenopus laevis
MSFDYFLYKGVKFSPGSYSQELLQYVENEFQVLDDDVYIVTYPKSGTHWLIEILSLINRDADPTWCNSVLIWLRSPWIETKEGQLQLKDLSSPRVLTSHLPFHIFPKAFFTSKAKIIYVMRNPKDIFVSLFYFAKIICHYKDPESFEQYLEDFLQGNILYNSWFEHVRGWMQMKDNSNFFIITYEELHQDLRGCILRICKFLGKELGDSKIDTIVKHSSFEAMKENKMSNYSLGTEEYIDHTKGTFMRKGTAGDWKNHFTVAQSEHFDRVYQEKMKDLNMKFFWEGK

SEQ ID NO: 417 - protein, 600 aa, Canis familiaris
MENSSAASASSEAGNSRSQEIEELERFIDSYVLEYQVQGLLADKTEGDGESEQTQSHISQWTADCSEQLDSSCSFSRGRAPPQQNGSKDNSLDMLGTDIWAANTFDSFSGATWDLQPEKLDFTQFHRKLRHTPKQPLPHIDREGCGKGKLEDGDGINLNDIEKVLPAWQGYHPMPHEVEIAHTKKLFRRRRNDRRRQQRPPGGNKPQQHSDHQPGSAKHNRDHQKSYQGGSVPHSSGRPTHHGYSQNRRWHHSNMKHPPGDKGEAGAHRNAKETVTMESPKLEDALGDTGHGGLEPPRSPDAPTPGAPERLPPQQPGGPEAETKRKDSIIPERIGERPKITLLQSSKDRLRRRLKEKVPDEVAVETTNPQQNKMDKLIEILNSMRNNSSDVDTKLTTFMEEAQNSTNSEEMLGEIVRTIYQKAVSDRSFAFTAAKLCDKMALFMVEGTKFRSLLLNMLQKDFTVREELQQQDVERWLGFITFLCEVFGTMRSSTGEPFRVLVCPIYTCLRELLQSQDVKEDAVLCCSMELQSTGRLLEEQLPEMMTELLASARDKMLCPSESMLTRSLLLEVIELHANSWNPLTPPITQYYNRTIQKLTA

SEQ ID NO: 418 - protein, 1329 aa, Homo sapiens
YDTSSVASSDSGDRTNLKRKKKLPDSFSLHGSVMRHSLLKGISAQIVSAADKVDAGLPTAIAVSSLIAVGTSHGLALIFGKDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLYSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 419 - protein, 715 aa, Xenopus laevis
MPIVEKLKDALKNAKNDTEDPELGKLLASSAKKILLQRIVFHPASSNLCYQLKALKSKYVFLSPQSQIAIYNGKTDGIPTLHQCVSVSSGRSDGVPVPQKILFPADKLSMKWDRISRVGAGLQNLGNTCFLNATVQCLTYTPPLANYLLSKEHTSNCQQSGFCMLCIMQNHLIQVFANSGNNVKPVSFIRELKRIARHFRFGSQEDAHEFLRYTIDAMQKACLNGYARLDRHSQATSLVHQIFGGYLRSRVTCSICKNVSDTYDPYLDIALEIRNVPNIVCALEMFVKSDILSGENAYMCARCKKKVPASKRFSVHRDSNVLTLSLKRFANSSGGKITKEVGYPEFLNLRPYMSQRNGNPVMYALYAVLVHSGYSCHAGHYYCYVKASNGQWFQMNDSLVHASNIKVVLNQQAYVLFYLRVSENRKHDNLTSKLQVRHSIHAIPSSANITKNHSSLYEEKGQKGKNLSSQEESGIPVLRKLSPFITKGHSSANPLRTLSDGICTKPNSSSLSIPFYVHNNISNDKKPLQTQQKIVPSKNRKLNVKTAKSVTCSAAEESHATPLSPHSTKNVMPTASTSESLSKTNILKSTSPTLESECEDTKGAVLQKRSKNHIPLPIPSSLTTGSTHLGSLDFDSTSSQQLHNHRECKEVYVGSRASCSFKKTERQTSPGETPHITPENQISNTVFNYEASSSLSPDKCSGSKCGMIEYKKKKK

SEQ ID NO: 420 - protein, 1044 aa, Homo sapiens
MVLSLTGLIAFSFLQATLALNPEDPNVCSHWESYAVTVQESYAHPFDQIYYTRCTDILNWFKCTRHRISYKTAYRRGLRTMYRRRSQCCPGYYENGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQRCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 421 - protein, 441 aa, Xenopus laevis
MTQSQSQALNIYTINANVLNSPWKRKALLQEIKAKKIHIALIQETHYKTDHIPKWYDKHFSNIIHSTPQPTKVRGTAILIANSLEFELDRIKNDTHGNYSFVKGKIHSEKQTFASIYLPNAEQNKVMEQICTQLLAFAEGTLILGGDLNTPLDPKIDCSSGTASITYKKIKQIKLQLQLLQVMDSWRIHHPTGRDYTHFSHSHNTHNRIDYIFLSHDTLDNLRDATIEATTWSDHSLVILRLHTPLTRPKQFTWKLNDSLRKDPKVLKIISTATEDYFQTNADTASSAIPEWEAYKCVIRGILIQQGARLKRDRQKLKQNLISKIQQLDQQHKLTRATHTLSDLTKARQELKLLIQKESDRATFLLKKLYYDHGNKCGKMLARALKTRERRSHIFKMKDSKGNVHVSPAGIQSTLTVHSDAFTSNKQLAMIHRQKTATLNI

SEQ ID NO: 422 - protein, 347 aa, Xenopus tropicalis
MPNEQFEGQDVQSLEKYRSFARYYQATEQEQKRSQWWRTYRQYQQEGEDTTREKADIGFPHFTPRNAKTTQARKQILRENHRNPELERAARLRTLRIPLDEVQAEWERTTGRSHVQRVAEHYGVFKDLFGDATFVPSVTLRVQYNKGDEFLMPVYHGNLVTPAEASGPPEVTFEAEEGSLWTLLLTNPDGHLKETDSEYVLWLVGNIPGNQVHSGEQICHYFPPFPAKGTGYHRHIFLLFKQDRRIEFKDELRPNPCHSLKLRTFKTLDFYRKYEESLTPAGLAFFQCAWDDSVTQVYHQLLNMREPVFEYERSPKYHPKQVKYPHGKPLRYLDRYRDSEEPTYGIY

SEQ ID NO: 423 - protein, 1415 aa, Xenopus laevis
MAGLIKKQILKHLSRFTKNLSPDKINLSTLKGEGQLTNLELDEEVLQNMLDLPTWLAINKVFCNKAAIRIPWTKLKTHPISLSLDKVIMEMSTCEEPRSCNGPSPLVTASGQSEYGFAEKVVEGISLSVNSIIIRIRAKAFNASFELSQLRIYSVNPSWQHGDLRFTRIQDPQRGEVLTFKEINWQMIRIEADAIQSCDHEIMSAPVRLITNQSKIRITLKRRLKDCNVVASKLIFMLDDLLWVLTDSQLKAMVQYAKSLSEAIEKSTEQRKSMASETTQSPTPPVSSQQVKNPQTSTTPEQNNAILKLFRDFDVKETSYHLVISHLDLHICDDIHSKEKAFVRRVTGGAMQLSFSQLTVDYYPYHREGDGCSHWMHYGDATKTRCSWAQELLHEFNSNIEMLRQAVKDHNPSSPIRTVPNASQQYGQTGFDQNVKRSSPTAFGEPPKSNPLSSSFVVRLADFNIFQVSTADQCRSSPKTMISCNKKSLYLPQEMSAIHIEFTEYYFPDGKNFPIPSPNLYVQLNALQFTLDEKSVLWLNQFVLDLRQSLDQFVAMYKLSDNSKSDEHVDIRVDGLMLKFIIPSQKKQDCHPDQPAGISIQTSEMIGSNTRQTANCRRSDLEAIFQDFKDYDFYSKNFTSFPRSHDHFDILHPIFQRHAFEQDTKMHDIYKGLVAPTLDTNALSTSAARDIWAIHFTQFWVDYEGIKSGKGRPVVFIDSFPFSIWICQPRRFLQSQKRTLCDGDPLQSISKSESTDFVGRLQRKKLLKQYYSTELGGSNTPLQKSQSLDSSLANPPTCKQTDADIHVLAHVQKHVSLQINHYQYIFLLLLQESIKQILENVKKDVEEVTGKPDDENKISVGLLLKSADVSLLLLPLPEDNSKSPLPCEGSPVTDHKLPSPSEGVTGDLIINNNVDLINKAIFESDLKGDPQKIVATDPLLSKSSSDTELLKRSPPYLDSTADKDLLEAELAFGQQIDRNNLKEDPGANIDISSSFLIHPLNNHINSNGPDHALAEDQFASPLLPEVEKKQLVDTSGIPKERCLPNLSVSYKNMKRSPSQFSLDNISIDSNLLDEQMIESDGSDHLEVGMEDFSSLNYPCTAETSSVELRNEEYCVSSPDAISAETSQDSRQDLMSVLVLKVVGINCGIDIKGEDATICLQINRVVPNQLGNVSVWQYLNSRNTGSDQKSTTDERKSSPEISLRLEIGPSARRHSPLAAENGFLQCNVSNFSSEFLTSTLANIHHFVEEDSVPEIMPMKIQVQNARIHLQDDSPRNNNTDPDPEPVVLNIENLFVERRDDGSFWIRGSPDTSLNSPWNHKETSSILQLDCSKSHSTNSKSKTSKFTQTISEHTSLPEIPDVINNQAWKAAGISKEQLVEENECLKQELAKTKMALAESHMERDRLLHQLKRVHIEK

SEQ ID NO: 424 - protein, 331 aa, Xenopus tropicalis
MGIDQEPKEKEQPRTPVQLLQSQLKDLKEASVELSEHFQEASPIYKARISELNCNLRSLLEREEKMRLFQSSQAEEQSVEHLEARAMDLCDLYSSIDHVLENLEGKHMTLKAKKQLRAFYEQFNAVAGTQTVLEMCISPLQLREWRGQRHLVKPVPESLTFDPHSAHPNLIVSSDLKQVRFQPSPTGKKSRECFDPGLYVLALPGFQSGRHYWEVDVGSRSSWIIGVVRESVERKVGHQLYPVNGYWALRKQQDGIYYGLEVSPIHLNLNFSPTRIGVCLDFFRGALGFFDADTTILIFELPCTSGEKLLPFFCPGIPVKEEDWCPLILCG

SEQ ID NO: 425 - protein, 715 aa, Xenopus laevis
MGGCVSRRSAKGAEESEFEQDFVAAHNSYRRKHGAPPLQLSRDLCRSAQQWADHLLSIQTLKHSGGDTGENLYYKYSSNARELPGHEPVDKWYDEIEDYDFSRPGFRSNTGHFTQVVWKESKEVGVGVATDGNGLFFVVGQYSPAGNITNSGYFEKNVLAAGSSPGIDKSGGSGGGGVTEPLRGFREPEKISTNWKPGPGLTKQAGAGSFEQEALDAHNRYRRQHGAPPLQLSRELCDSSRKWADYLLSINALQHSNTTNGENLWYKWNSSMRDASGSEVVDTWYNEIKDYNFGRPGFQSNTGHFTQVVWKDSREVGIAKAVDGKGMVIAVAQYSPAGNITNPGYFQKNILPKGTPVSDAGTSPTDRGTSNTSYVGTRGTDSASSPTADAREFALDFLKANNAYRSRHGAKPLQLSSKISQEAQRWAEHLLTLKTLKPSDTSHGENIWAKSGGPSITATGQEVADSWYKEEKNYNFSKSGYQADTGHFTQMVWKASKEVGVGLAFSGKGMIIVVARYNPSGNITNPGFYSRNVLPRGSKVTADDVDEDGFVKDTSSNDVLPIPEKELKAFRKDLLSEHNMYRKLHGSGALKLSAALSQEAQKWADHLVPKRALQHSDTHHGQNLWYQWGTDTSLPTGKEVAETWYNENAKYSFSTPGFQSGSGNFTQMIWKSSSQVGFGLSTDSRGMYIVVGFYDPAGNISNKSYFQDNVLPRKK

SEQ ID NO: 426 - protein, 1363 aa, Canis familiaris
MAPKGNSVLHLPLWVCPDCRRAVEKEERPSSLDQPSPEAGGGRLALGAQTLPSAGLGTAPSDATCACEACSERREISAETDREPQQLQNYWSEVRYMVRCIYRQAGTPLADDQDQSLVPDKEGVKELVDRLCERDPYQLYQRLEQQAREYVLEMKVRLLRQLSAASKVKAPSALQGPPQAHQFISLLLEEYGALCQAARTISTFLGTLENEHLKKFQVTWELHNKHLFENLVFSEPLLQSNLPALVSQIRLGTTTHDTCNEDTYSTLLQRYQRSEEELRRVAEEWLECQQRIDAYVDEQMTMKTKQRMLTEDWELFKQRRFIEEQLTNKKAVAGENNFTDAMRHMLSSRLSMPDCPNCNYRRRCACDDCSLSHILTCGVMDPPVTGDIHSHQLPLQVDSAPDYLSEMRPPSVSSASSGSGSSSPITIQQHPRLILTDNGSAPTFCSDDEDVAPLSAKFADIYPLSNYDDAEVVANMNGLHSELNGGGENMALKDESPQVSSTSSSSSEADDEEADGESSGEPPGAPKQDVALGSGSPRKEESKVDSPPPSYPTQQAEQAPNTCECHVCKQEASGLTASAMTAAALPPGHQFMSPEKPTHPALHLYPHIHGHVPLHAVPHLPRPLIHPTLYTAPPFTHSKALPPAPVQNHTNKHQVFNASLQDHIYPSCFGNTPEWNSSKFISLWGSEVMNDKNWNPGTFLPDTISGSDILGPTLSETRPEALPTPSSGETPMVSESKEKKNAAKKKCLYNFQDAFMEANKVVMATSSATSSVSCTATTVQSSNSQFKVSSKRPPSIGEVFHGVKEDHRHAVPAAPRNSPTGLAPLPALAPAALAPASSPHLASLAAPSFPNTAATSPGFVDTRKSFCPAPGAPPPPTTDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKADQLSDRESVVDHRRVEDLLQFINSSETKPVSSTRAAKRARHKQRKLEEKARLEAEARAREHLHLREEQRRQEEEEEFQRLQELQKLRAVKKKKKERPSKDCPKLDMLARNFQAATESVPNSETMHNGSLEQMEEPETSSLSPSTHGDHSEARPGPGVDGDAASPVDARDSKLLLPKEASGKQQEPLSFLLDIMHHHKEGNSKQKLKQTSKAGSEPARKPADSPRASEGQPRPRPQTEPKAKVLDLASLAEQKREERRVNSNNNNKKQLNHVKEERLPPAPLEPAPPSEPLPDSKLVLADSPQPKGKSKKNRKKKGDRVNSSIDDVFLPKDIDLDSVDMDETEREVEYFKRFCLDSARQTRQRLSINWSNFSLKKATFAAH

SEQ ID NO: 427 - protein, 1624 aa, Xenopus laevis
MEPPGIKRKLRISLNPPVLFSFLLVSLSLPATEAVEVKVSDSPVKVLKDQDVFIPCTISRYSSTELDLQRLSVQWILGSDPVYIYDGGSHNPIRPGSQLDIHLIKGNAGLYLAQVQVAEEGEYTCTVTYDNEEDEGRSSLEVSVEPSARLVPTDVIIEEGTERWVTCQANNYYPETIKFQWIKHLSDAQHIVLRQGVSTNEPLENEDGTFNVTSQLMIKPSMEDDREKYSCIISHRSLGNSLVLNFILSVKESHIVLIRAVVGTLAALILPFFIWGYKTLLRNEPPRLSPITGSKYLLHKKKAKLCFQISGFRPKPIHITLYLKRKWGESAEIYSWNSEVQTGSSAPQNKDGNGTAEMEQSVSDADLENLSRMQLQMVPDVKSSRTGICTCLCTINITPDIHEDEGAELTVQVNHITLMSPISVFCRLKVMKEPLRLSPISGAERLVHMRKSTLSCQIPKSLLEPTEITLYLQRKGEEQIEILSWKSVAYKANAEQLVSNMETNLPAALRPLQVEMDPVITACTNGDSNCQCTIHITPDIEEDDGAELTVSVNHPELRDPFSVSCRLVVNEETMLLVIDEDYRVRVGPAPLDPTDNFHERAITLGRLDGLDNIALSPTGTLFVIREGNLYTGPVSSCTNQILFSLDRRIGCGAWDMFKLISVDPRGLLCSVGDCGSIYRGPHPENESQNWIGDLGPYVGKCKCSDVDVVFFDPLGTLYAITSDGWIKTLFKPAETDSDWLDLGAALIKRDSRDSPHGISFCPEGNLWWVSKTEGKLYKGPQPTQQNPVYWEEATLLGQDYNQYRLFGFIGGTFIQRIQSFEFFPELGKIVKERNIIVNSETYDNSKGDNTLNDTFSLKKTIMEVSRFIHDHNIVFVEEAETTFMEGIPVIGMERGSKISLDNNITHQWDFTNTNEPEVTLSLQEPVVVGIGKTTHMEASVQKAKISVPYKVRLLTGQGCTVTIGGSWKATTFYNLRAAPRESQREKKRSHLKSSAEDIWKEESCFNSRLMYSDGWVRERSNNETCIPRCRLKKEPPKPSSHFSFIGAERLVHMRKSTLSCQIPESLPEPTEITLYLQRKGEEQTEILSWKSGEKLLPFTAVSKIPEAPVATESEREEAVSNGETKLAPAQRPLGVEMFPIITTSKNGDSNCRCTIHITPNIEEDDGAELTVRVTQSALSSPFSVSCRLEVNEETMLLVMDEDYRVRVGPAPQDPTDNFHERAITLGRLDGLENIALSTTGTLFAIREGNLYTGPVSSCTNQILFSVDRRIGCGAWDMFKLISVDPRGFLCAVKDLGSVYRGPRPDNESQNWIGDLGEHVGNYNCSDVDVVFFDPQGSLYAITSDGQIKMWVKSAKTDSDWLDLGTALKERDSRDSPHVISFCPEGNLWWVSKTEGKLYKGPQPTQQNPVYWEEATLLGQDYNQYRLFGFIGGTFIQRIQGFEFFPELGEIVTEKSMILNTETYDNSDGSSTLNETFSFKKTIKEVSRFIHDHNIVFVEVAETTFMDGIPVIDIERDSKISFENITHRWDFTNTNEREVTLSLQEPVVVESGKTIRMEASIQKAKISVPYKVQLLTGQGRTVTIEGSWEGTTFYNLSAAPRDVWGRRSGLGCTFTDSCEEENYFD

SEQ ID NO: 428 - protein, 280 aa, Homo sapiens
MATEAPVNIAPPECSTVVSTAVDSLIWQPNSLNMHMIRPKSAKGRTRPSLQKSQGVEVCAHHIPSPPPAIPYELPSSQKPGACAPKSPNQGASDEIPELQQQVPTGASSSLNKYPVLPSINRKNLEEEAVETVAKKASSLQLSSIRALYQDETGTMKTSEEDSRARACAVERKFIVRTKKQGSSRAGNLEEPSDQEPRLLLAVRSPTGQRFVRHFRPTDDLQTIVAVAEQKNKTSYRHCSIETMEVPRRRFSDLTKSLQECRIPHKSVLGISLEDGEGWP

SEQ ID NO: 429 - protein, 637 aa, Xenopus laevis
LLVKPVNTAVPKKNKANKGFASQSNTSFPPSLPNGGHEGRLPEQSSSRLQPVLSRRHCLCNVCGKSFMWLSALNIHKRIHTGERPYKCSTCGRGFSQKTNLTRHQRNHTGEKPYGCTVCERRFTQKQHLSKHAKTHERLQNYQCTDCGKSFFNRQQLIKHQKIHRDPKIFLCKECGMCFPLKSNLKMHQKMHVKEAAFERKKSLKEKMLDKLQTRVKLERDSPGPPKRCETAFSWRSVGHPKIHPRERRFICNECGKSFSWWSALLMHMRMHTGEKPYKCSECGKGFRGCQSLTIHQRTHTGERPYKCMQCGKSFSQRPNLVRHQRKHTGEKPYVCPHCGKGFTQKQHMTKHLHVHSTDRQYKCKECGVVFKDLVTLSQHRKVHVKEQVCSCTVCGKNFIWLPKGTTSQKRPVKGKRKKCPQCEKVCKSQVNKKRSQGRAARNQALSIQREKVGPLQKQIKVKPFHCDQCGKSFGWWSAFNIHQRRHTGEKPYACTECGKNFTWWSALIIHQRTHTGERPFKCQSCGKSFSQKPNLVRHLRRHTGEKPYQCNECGKRFTQKQHLSKHQNTHGQGGDLRRGSRAGKKTTARRDLPRHLVESEALYNALPAVDFSQPLMSLPTESHALPKLFYHTKRPF

SEQ ID NO: 430 - protein, 531 aa, Xenopus laevis
LSVMAAADMGEELTCSICLSIYTDPVTLPCGHYFCQGCIGKVLDTQEESGGYSCPECRAEYQERPALQRNRKLGNIAERFLYTHPEQDRTGIFCTYCIQAPVPAAKSCLLCEASLCDAHVRVHSKSAEHVLTEPTTSLGKRKCSVHNELLKYYCCEDGACICVSCCLAGEHRGHRVELLNEASEKKKEKLRNVLEKLKPEREQTMKKLKSMQCSKRRLVKKAAGETERITALFRVIREQLEALEKRLLSDISRQKEELFLQLWDLTEQLEIKKDELSRKIHHIEELCNMADPLTVLQEQESNVTAFCGAEGADNEDRKKSDIKVPAVGDLDELLISETLLTGLAGIVTGVKETIYGQEATDMLLDINTAGKYVAISEDKKSASCAETDQCHPQTPDSFQYAQVLSTTEFSSGRHYWEVEGSESQDWGLGVSYRSIEKQGLQSVFGKNNKSWCLYQGDLVDCITMHNSEVKSVSPKISCNRFRISLDYEAGRLSFYELSEPIRHLHTLNTNFTEPLHAAFGIWMDSWVRIIS

SEQ ID NO: 431 - protein, 574 aa, Xenopus laevis
MSHTEDRRYVELCQDSVRLTAESVGLDITDEVAALLAEDVCYRLRELTQFSAQGLRHSRRRRLTVEDFNRALRWSNVEAVCGHGSSDAVTYRSIKDGDCHYTEDREINLVELALATNIPKGTPETAVRVHVSYLDGKGNLEHQGTVPAAVSLLTDDLLKYYQRVTRAVLGDDPHLMKVALQDLQTNSKIAALLPYFVYVVSGVKSVSHDLEQLSRLLQLVRSLLWNPFLYLGHYGCSLMQSVLYCVTEPLAASINPLNDHWTLRDYGAGLLSLIWTHQDLAGSMYPQILQSLQKVLGDPVRPLCSHYGAVVGLHALGWKSVEQILYPLLPTYWAGLQTVLDDHSMSNAQVKADGHKVYGAILVAVERLLKMKARSSDLTSSAMPSLPHASICSPPSVSLLEMYSELYCFFGDSLAVRFGTGGNQSHHGGAPQNIQESKKECTGDGTRKMPQLTAHGEDEAVTVGKQCQRPPQTQISVASRPRGTSRQGQRTQGIREAFQRSRLTPRGTPRFTFLIGGRQAGRGGGGRRFQSVFQLHTGPAATASRYAQKLPMIGRVARAGRRVAQAELSLYLPL

SEQ ID NO: 432 - protein, 1643 aa, Xenopus laevis
MASRAAPPDRVKGFHAKEASERHSLRDVSCTRLSSDLLRLYNEELHTDVVFYVGQRIFKAHKAILLARVPKFYSFIIGQLEAETISVANIEPTEINTFLQYVYSSHWNVKEREEHILSLINGDKIVSNTNQNGDAQNTVQSNTLCTEKATEASFELEDLESASELGKDLLKLFQGSLCPDVTIQIEHRCFHVHRAILCARSCYFSAMMSGHWAESSRELIHIQGINQMDMMVIMHFIYGGIIDLPKNADPGHILCIADMYGLEGLKAVAIYVLRRDYCKFFLKPVVGMQQSVLECLSIADSLGEEQLYTACMRWVEKYFVKCWSERSFANLQPDLQKKCFEYLVKSLSYRNAAFILMESEKLLSLLPSVKWAERATNLASELKEACVQYIVTHFAQIIKTENFFNLLQAQGMSSRPYLLEHILNETEKNISFQNCCSLFLALDELLDLASNNEMGFTSKIQALRDKLWTFLVQSFYAVRHSEGWKLMRPEHQQKIESAALDKGDDRRLAKKPIFTSSQQSRSRLTETKEIRLSVNRTSSKSNLSVEKKMKSESFGASGNTSTAFRNSSAKAKDDDLKSKDGKKMLTKGIKDQKQPEKNITTKPKTVLKVKTESHGTAKTETCASKGDATVASKSLSSGRLGARPKASSDSNSQSKPRAAKSISKNLACPVKGTVNIKPANSAAESANALGSSEEQICQTASDDQTSANSSPQSCKILPNCLDSPKDLGQAVKSKSTAKMSNGSFIKKKINEVECHGGTNSISTTKNVSSAKESVTEKKKTTKCSISTAQQRPKSAPAAVSKKQGTCLPGSGACPQRSAASKQTEIKSDIKGVNKNISKNALSSNKTSAKQKVQTIKNTLSDNICSNTNHKESKQKTVTGSKSSKAANLNTRREFKDSPCALKTSWEQQMLQPNKDSAKQDDYKPSFSLENECQQILCHSSEQPSGHSEEIGVKDITISMNECCQDNSVDKQFSVAQKCMSDLCCSEQNIAEHGVSEETVTKDVENKASNEANLALNILGCNHSESKHICDSENSKCADSSSESELCSVKEVDRNYSNTNGQTGDTESPFIASQATNGHTSQRSAINAGEHYMSESSVDISIGLTIDSSESKLALHWNKHLNTLHDRESPESESVSASTSSDDIKPRSEDYDAGGSQDDDGSNERGISKCSTMRCHDFLGRSSSDTSTPEELKGYDGSLRIDVKIKKDHPSDLFRVNSTSDDEVPQKRAEIWAQRDISKSNTNKKAVNGSIPFTHEIEHLSSADETEDERSEAENAAEKALSDAALQPFQGIVNLAFDDLNELDSVNLQAAANKNFSRSVLLSVDECEELGSDEGDLNTLLKRDPLTPSDVFEKITNEHSGAHHLGCSHIESTFSDVILQIECRDLQNGTLLNLDPSNEAYPKCASSEKQPSQEEGKDCIESEICSGNYTQAESDFKSQIRPCHLDLYTTETLPDSQKFFYTGNSCKSRFHDHQERDILASPSEKCSSAGHIDDFDSLAQICMYERRPSKSLSPIYEVDPGQGIEQNKNTEAKIVDFGFEDQHFVERDWILLRQLLADHGSDVDIINSVPEDLSLAQYLINQTLLLSREQSKSQGVTQVENSSRSGDIASPYDDSTSITVTSFSPDDLSSPNGEWTILELETHH

SEQ ID NO: 433 - protein, 166 aa, Xenopus tropicalis
MAGSTPNRGVCAFCGLREQNKETGRLLKTSDDKITAHLNCTIFSPKVITTVSSNENFGGFDINSVKKEIKRGEKVKCKLKTCRKRGATIGCDIEDCKKTYHYMCAKNDGAKIINNEEKEKYIILCKHHRTDKQDEAGDSRRSETSSDSSTSSSTDDSDTLGTPRAR

SEQ ID NO: 434 - protein, 525 aa, Xenopus laevis
MARLLHLGLYLFIVLSCHLTNSHVVEWTYQEGELDEANWGKKYPTCAAKHQSPIDIQRKKVRHNPELTQLELIGYDGPLTGHFKVTNNGHSVQIDLPSTMTIKKGLNSLYTAVQMHLHWGGLESETSGSEHTIDGMRYLAELHIVHYNSGAYKSFDEAKDKPNGLAVLAFLYTTGNYENTYYSDFISKLAKIRYAGQETEMHTLDVMAMLPENLVNFYRYDGSLTTPPCTENVLWTVFDSPVFLSKTQIDLLENTLLDWHNKTLRNDYRHAQPWHDRTVEASFHPKMPKDSCQQEISNKLLLIETELQDMKKRADSSKSRLLVSGSPSYPSFYFSKDHLAARVEVRPAESMKMARFTICVWVRTKNEGSQTIFSYSTNNRDNELVLSVGNDIGVWIGGEFINFNIHHTSEDWVHYCVSWDSQNGAAKLWVSGLPGKEKTIQHGYEIQDKGMILLGKNPDDPLGVFSSGYVGWISQLHLWNYLLEPEHIKSLNQCNMLVARGNVVAWGETKMSISGGVILEPDNSC

SEQ ID NO: 435 - protein, 1355 aa, Macaca mulatta
MHNMGDTVTVRSQKSYLDSLDVSRQEEAEGELSEGEHWYGNSSETPSEASFGEVQENYKLSLEDRIQEQSTSPDTSLGSTTPSSHTLELVALDGEVLRDSLQCQDHLSPGVSSLCDDDPGSNKPLSSNLRRLLEAGSLKLDAAATANGRVESPVNVGSNLSFSPPSHHAQQLSVLARKLAEKQEQNDQYTPSNRFIWNQGKWLPNSTTTCSLSPDSAILKLKAAANAVLQDKSLTRTEETMRFESFSSPFSSQSASSTLAALSKKVSERSLTPGQEHPPPASSFLSLASMTSSAALLKEVAARAAGSLLAEKSSLLPEDPLPPPPSEKKPEKVSPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGNVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSESVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLKCPFCIYSTNRPAAMECHLKTHYKMEYKCRICQTVKANQLELETHTREHRLGNHYKCDQCGYLSKTANKLIEHVRVHTGERPFHCDQCSYSCKRKDNLNLHKKLKHAPRQTFSCEECLFKTTHPFVFSRHVKKHQSGDCPEEDKKGLCPAPKEPAGPGAPLLVVGSSRNLLSPLSVMSASQALQTVALTAAQGSSSEPNLALKALAFNGSPLRFDKYRNSDFAHLIPLTMLYPKNHLDLTFHPPRPQTAPPSIPSPKHSFLAYLGLRERAETV

SEQ ID NO: 436 - protein, 317 aa, Xenopus laevis
MWVLLLLLVPLSLLYRWYKDRHILDNLTDKYVLITGCDSGFGNLLARKLDRRGIHVLAACLTDRGAEELKKQTSSGLQTILLDVTDSKSVKSAEKWASQIVGDKGLWGLVNNAGISFPCAPNEWLTKEDFIKIMNVNLLGLVDVTINMLHLIRKARGRVVNIASVAGRITFSGGGYCMSKYGVESFSDSLRREMRPFGVKVSIVEPGFFKTQITNTDLVNQSLEKAWNNTTEEIRQSYGQEYFEKSCKASETIVPLCKGDLSLVTDCLEHALTAIHPRTRYSAGWDAKLLFLPLSYFPTSLVDFLFGIDNPKPAQGV

SEQ ID NO: 437 - protein, 686 aa, Bos taurus
MPDSALPAAETGGRRYQSCRHGLLMPQNAFEPLKRCTPGTGERARDAEVRETASALVSAKHWTCPPALDLAVTFTAGLRLKTPRGSIPKGSLRNKAPLPSLLGPHPPKPQLSPSDPVRNDPTMAKLWFKFQRYFRRKPVRFFTFLVLYLTAGSLVFLHSGFVGQPAVSQNQANPAVGAPVEGAELTFLGDLNLGRGFRDTGEVSSIARRYGPWFKGKDGNERAKLGDYGGAWSRALKGRVVREKEEERAKYIGCYLDDTQSRALRGVSFFDYKKMTVFRCQDNCAERGYLYAGLEFGAECYCGHKIQAANVSEAECDMDCKGERGSVCGGANRLSVYRLQLAQESARRYGSAVFRGCFRRPDNLSLALPVTAAMPNMSVDKCVDLCTEKEYPLAALAGTACHCGFPTTRFPLHEREDEQLCAQKCSAEEFESCGTPSYFIVYQTQVQDNRCMDRRFLPAKSKQLIALASFPGAGNTWARHLIELATGFYTGSYYFDGSLYNKGFKGERDHWRSGRTICIKTHESGQKEIEAFEAAILLIRNPYKALMAEFNRKYGGHIGFAAHAHWKGKEWPEFVRNYAPWWATHTLDWLKFGKKVLVVHFEDLKRDLFVQLGRMVGLLGVAVREDRLLCVESQKDGNFKRSGLRKLEYDPYTADMQRTISAYIKTVDAALRGRNLTGVPDDYYPR

SEQ ID NO: 438 - protein, 560 aa, Xenopus laevis
MTFCNFQWHLVLLNFMTCGLEICVAAGITYVPPLLLEAGVEEQYMTMVLGIGPVLGLIFVPLIGSASDNCQSTLGRRRPFIWLLSVGVLLSLFIIPHADSLASFFSNREKNAHIFILIFGVGLLDCCVQVCFTPLEALLSDLCHDDDGCGQAFAMFSFMISFGGCIGYLLTSVNWNYTYISLYFGGQDECLFLLLTVIFIISVLVTMKTSEEPFYNSQQRMDLKPTSTSGLLHRGCCMPKWKLRSWKCNPLFCLLSLCWSVTPRVYSSYCRIPSVMKQLCAAQLCSWMAVMSFMLFYTDFVGEGLYNGIPSAAPGTESRLRYDEGIRMGSIGLFLQCAISTFFSVIMNKLTKHFGSRRIYLASMVTFTSSALVICLSQNIVIVTIMSSLTGFAYATLQTLPYTLICLYHKEQDVFMPRAVLSQNKNGYTLTKEAVYFSSNNNEDGTFKHNGAPQGKEKHIYIPHELETYTQDYPYPSNSILPAVQKETSQDNYTQRGIGLDFATLDSAFLLSQVFPSLFMGMIVQFMENVTVYIASSVLFGVFAIYLASRVVFDQKDLKL

SEQ ID NO: 439 - protein, 582 aa, Xenopus laevis
RTRGSTHASAHASASGCTLTPTAMASSTQPRSCNVTKQEGKGFGFYLRIEKGEVGHLIRSIEPSSSAEKSGLKDGDRLLRVNGKFVDDKEHAEVVTMIKDSGTTVSLVVLDKIAYENAKKKGDDLSKLDQNSNQPAKQPEAPQPAGQPLANGGKAMARRPRLCYLVKEGNSSYGFSLKTTKTESGIFLSALVPNGAAVKAGVKDEDHIIEVNGENVENSTHEKLAKTLKESGGRIMFLLSDKETDEYFKSQKMKITADKANVDLLPSKPRTVELKKDTNGYGFYLRQEKNRKGHFIMEIDSGSPAQKAKLQDYDRIVAVNGECVEGTEHEEVVKAIQKGGDKTTLLIVDKKTDEMYTLAGVSPYLFLQETQGEIKSNIKEEPTPVPAVIPSQKPATTTPTIAPAPIAAVEPKKPETPAVPANDQQHKPRLCKLQKSNNGYGFHLNAIKDTQGQFMNQVVKGGPADVAGIKDKDVLLEVNGANVEKESYEDVLIKIKETKGTLALLVASQEAYDYFKEQKIPITASMADPVSEVSPNSNVVEPASKARAAPEPIEMQSNQKPVETPKEKEEEKEEQEEGDTNL

SEQ ID NO: 440 - protein, 543 aa, Xenopus tropicalis; identical to SEQ ID NO: 174

SEQ ID NO: 441 - protein, 285 aa, Xenopus tropicalis
GYYMARSKIPTVPLASGQHIPLLGLGMSHVGGYCHNALLYALTTCGIRHIDTAKRYGNEVMVGKAICESGVKREELWLTTKLWPGDYGYENAIQACLDSCKRLGVDYLDLYLMHWPDAQIPGKSAREARAETWQALEELNERGICRSIGVSNFLIHHLDQLKEDCNMVPHLNQVEYHPFQRPQELVDYCRRNNIVFEGFCPLAKGQALNHPVIQKIAKNYGKTPAQVCIRWSIQNGIVTIPKSTKEERIQENCEVFGFVLADEDVLALNALHDGRHISWDPSNIL

SEQ ID NO: 442 - protein, 777 aa, Danio rerio
MASKQSFHSRMFFLCPVCKKAPHSLPGHLRKVCMRNSTEAEIQAVVKEAKKELSEFCHKGRFWEFGKICDILDSTNPLARMIAEMQSKGLVINNLPSVLPEPARSTTSSVPQSSGEGAESPLEPPNESLSDESSGEYYQSTGGPMWTSSVRVEMVKKGLYNKHSIDHPLLAGFNKYLYTDLGYKNSKQVVETVSRFLHYMDPTEPNLMFVRRVEKVREYFNILSDTKLSKWTVFNYSKSLKRFMKYIITSTDIRHNNPSLFQDCESFMDTLYGIQSGKSKEVSMEVTAKKSEFGCGKEVLPKDCLAVLEAAFKDFQAVICKMQGPGAITGDCLTKNERLLVLYYLEAVIMLKLVQRPGIVTHMTVKDWEGRSQIKNGVCVAVKEHKVPLSHEQELWFDLYLNEVRPVMLQENRTGDDVAVDSFFVSSSGRSIYNPSNDLKRLHDKYSLPSVTCGDAQRAFEAAAQNLSEEERNVVAAERIYMRGTSSDLFLALSVLDQLAGKTPQRSSRASSCETRVDEQTAYKTLEQFCPVTLEGPPPKRARRTELCGSEHERHCYDRWRSEQLKLREQHALEHFAGQQPSESKINRWMDKQGWTSNVPQAAVVLKQWKPVARLDLDIDSSFVKKIILSQRWKGLTVRPVPDKGDGVFTKRPFQIGEVVCEYHGELVSHEDGMAIASTSGIRAGHLFFYKNKQHEAMCIDAHEESCQCHPMKFNYGRLIRHSSKRANIRPRLYVLNDRDIILFIATKDISSDEELLYDYGSKRRSFAGKGLELDWM

SEQ ID NO: 443 - protein, 155 aa, Macaca mulatta
MHKNSKRNSNSRVSHTEVNSVDAEKEKNESENNFVELLPQELTFKIFSQLDIRSLCRASLTCRSWNYTIRNSDSLWKPHCMTVRAVCRREIDDDLESGYSWRVILLRNYQKSKVKHEWLSGRYSNICSPISLPEKTMYPMDADTWGEILEAELER

SEQ ID NO: 444 - protein, 1278 aa, Homo sapiens
MQKFLEKGGNFWVTAMETGVPEIKSLDQYDFSRAKAAASLAWVLRAAFGGAEHVPPELWEPFYTDQYAQEHVKPPVTRLLLSAELYCRAWRQALPQLETPPNPSALLALLARRGTVPALPERPVREADLRHQPILMGAHLAVIDALMAAFAFEWTKTLPGPLALTSLEHKLLFWVDTTVRRLQEKTEQEAAQRASPAAPADGAAPAQPSCPTRWYWKLVPHAIAFCLKESGSKPPMIRYRKDRVVARRAPCFPTVTSLQDLASGAALAATIHCYCPQLLRLEEVCLKDPMSVADSLYNLQLVQDFCASRLPRGCPLSLEDLLYVPPPLKVNLVVMLAELFMCFEVLKPDFVQVKDLPDGHAASPRGTEASPPQNNSGSSSPVFTFRHPLLSSGGPQSPLRGSTGSLKSSPSMSHMEALGKAWNRQLSRPLSQAVSFSTPFGLDSDVDVVMGDPVLLRSVSSDSLGPPRPAPARTPTQPPPEPGDLPTIEEALQIIHSAEPRLLPDGAADGSFYLHSPEGPSKPSLASPYLPEGTSKPLSDRPTKAPVYMPHPETPSKPSPCLVGEASKPPAPSEGSPKAVASSPAATNSEVKMTSFAERKKQLVKAEAEAGAGSPTSTPAPPEALSSEMSELSARLEEKRRAIEAQKRRIEAIFAKHRQRLGKSAFLQVQPREASGEAEAEAEEADSGPVPGGERPAGEGQGEPTSRPKAVTFSPDLGPVPHEGLGEYNRAVSKLSAALSSLQRDMQRLTDQQQRLLAPPEAPGSAPPPAAWVIPGPTTGPKAASPSPARRVPATRRSPGPGPSQSPRSPKHTRPAELRLAPLTRVLTPPHDVDSLPHLRKFSPSQVPVQTRSSILLAEETPPEEPAARPGLIEIPLGSLADPAAEDEGDGSPAGAEDSLEEEASSEGEPRVGLGFFYKDEDKPEDEMAQKRASLLERQQRRAEEARRRKQWQEVEKEQRREEAARLAQEEAPGPAPLVSAVPMATPAPAARAPAEEEVGPRKGDFTRQEYERRAQLKLMDDLDKVLRPRAAGSGGPGRGGRRATRPRSGCCDDSALARSPARGLLGSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 445 - protein, 343 aa, Xenopus laevis
MFLRSIADLLLTAALLHLPLALSMEVYTTSYGGTCIGTCGRENSDYYWCKQKGGDTGWWDYCSPEKGYDAYYRPCLSACQKVTGSKYEQCFTDNGWSKCGHVVEEFERYYTSSNILCASECMSNEDYYKCTDVNGDEDKCSLLNDLTAKGEPCRTDHPCDSHGNSYTWCYTDTSNNWDYCGKVISDCEPKRHKRANGDDEVCRVIDTGNKRELVLTAVEVPASDFRQPSRAQFTEASHLINTVGADFCFPSTARTVANSENIRMDMQGTFERDGVRYMNVQLQLNEPRQGSSTRHSTTIAQILFPQDLDVAVFSRYIRRALQTSMRSAYHGPPVRITININPV

SEQ ID NO: 446 - protein, 773 aa, Canis familiaris
MAHEAMEYNLHGQLDHHVAEQPVPAEVVISLEGPPVFQALPAEVVISQEGPPVLQALPAEVVSSQEGPPLPQPAPHVSVGLTEEGELLGEDRVESINPGASEEHSQRSRVNPPVQVSSLDSMNSFISGLQRLHGMLEFLRPPSDHNVGPVRSRRMRGSSRRSRTTGSQRTDSTRSRAPLDAYFQVSRTQPHLPTTSRDSETRNPVSEDLQVSSSSNSDSDSSTEFEEVVAQAEETRAAVLEEQVEGSSAQQEVTCISGGETFPKQSPQKTDPLLPSVPMDDEEGDTCTICLEHWTNAGDHRLSALRCGHLFGYKCISKWLKGQARKCPQCNKKAKHSDIVVLYARTLRALDTSEHEHMKSSLLKEQMLRKQAELESAQCRLQLQVLTDECSKLHSRVQDLQKLIVQHREQISQHPRGSQACFPNCLPSSQSQHKYHFQKTFTVSQTGNCRIMTYCDTLSCLVMSQPSPEASFLPGFGVKMLSTANMKSSQYIPMHGKQIRGLAFSSRSKGLLLSASLDSTVKLTSLETNTVVQTYNAGRPVWSCCWCLDESNHIYAGLVNGSILLYDLRNTSSHIQELAPQKARCPLVSLSYIPRAASSAFPYGGVLAGTLENASFWELKMGFSHWPHTLPMEPGGYVDFQTESSTRHCLVTYRPDKNHSTLRSVLMEMSYKLDDAGEPVCICHPVQTFLGGPTCKLLTKSAIFQNPENDGSILVCTGDEASNSALLWDAGSGSLLQELQAGQPVLDICPFEVNHSSYLATLTEKVVHIYRWE

SEQ ID NO: 447 - protein, 299 aa, Danio rerio
MFYDYLIQNFVVLKIKVLPSQSQGKKTQTVQGLADGHVLDHFWDSPDCVKFFYKEKIPDLGAFQPNLVRICQRFLNTYHFATLYDTYHRIAVYSAYIFEPSSGGGREKRWFVEPQLVSPAWSTEMEDGYKLSQQNPDIYLGEKQALNEDYTNSGFDRGHLNPNGHHAVPSRNATFTLTNVVPQNPTLNQNAWNKHESKLTSLFKANCHQAYVLVGAIPSSNNWIIKNNVKRVNIPEYLWDAFCCIDQNGRPILSGAATALNTELNVVVERSLDEMVDFIQQFSDAPVNELFSGQCKAAN

SEQ ID NO: 448 - protein, 830 aa, Gallus gallus
MESVYSVEPALDGAGPTSLDILSFLDTLVNSTEEQCFSARSRSTVLQGLPFGGVPTVLAINFILWLLLLLIFSCLRKAAWDYGRLALLMDNDSLTSLFYGEQSEKEKSPSESSPLDADNKDMGFCSWLLSIYQMKDEEIQSKCGIDATTYLSFQRHLLVLLMLVCVLSVAVILPVNFSGDLLGHNPTHFGRTTIANIPTQDRLLWLHSIFALIYFILTILCMAHHSIHLEYRENEKVARTLMVTHIPMEITDPSLIIKHFHEAYPSCTVTNIQFCFDVRKLMKLDAERRKAMKGRLYFTTKAQKEGKIMIKTHPCARIFCCRFCGFEQVDAEQYYGELEEKLTDEFNAERNRITLKRLDMAFVTFQDERMTAVILKDYSHTHCRKHPQQSSVTTVVKSHQWGVRYAPAPSDIIWENLSVRGTSWWVRFIFLNICLFILLFFLTTPAIIVNTMDMFNVTRPVESLKNPIVTQFFPTLLLWAFSVFLPFLVYYSAFFESHWTRSSENQLTMHKCFFFLVFMVIILPSLGLTSLDLFFRWLFDTHFLDQADIKFQCVFLPDNGAFFVNYVVTSSLIGTAMELLRIPGLLVYTARLCLAKSEPERLHIKRSQAYQFQFGLEYAWTSCIFSVVMTYSITCPIIVPFGLLYMLLKHMVDRYNIYYVYIPTKLNQRLHVAAISQVVVAPILCMFWLLFFSVLRLGPTRPVTLFTFVILLSCIVFSFFGLCLKKLQPRKPSSYQMSDQSEGSFADAERSSVSSTPNSNLFVATVLQEPELSLTPAASPAHQSYGTMGNHLELAEEGEDCGLQNFETELETVEGEYRTGPVMESQPRYQ

SEQ ID NO: 449 - protein, 181 aa, Xenopus tropicalis
MNFPHLVSLASYLATHGIFCLRFTCKGLNLVYRTKAYRAVLAFLKSHEEHKISSVFLAGRSMGSRAAASVMREACENDNEFIQGLICLSYPLHPANSKAKLRDEDILSLTKPVLFVSGSSDEMCDQTLLKNVVSKMKVPAQIHWIKNANHGMAVKGETMEDVMTEINTHVFSWIQKTVDNL

SEQ ID NO: 450 - protein, 246 aa, Xenopus tropicalis
TELGVKFSEKGCIGCRHKTSAKDKEKPYTCTDCGISFSAMAKLRRHHGSRAVKQPFTCAFCGGCFPRISCLLIHQRTHPAKTVFTCHTCGRSFSNRTCLLSHQISHAEEKPFTCSECGRTFSQIGTLSSHQRIHTGEKPFSCTECGRTFSQKSTLRSHQRIHTGEKPYTCSECGKSFSLNSTLHTHQRYHRKENNFTCGECGNKFPTKSNLLQHQRIHTGEKPFICTTCGRSFTRGNSLRDHQRVH

SEQ ID NO: 451 - protein, 550 aa, Homo sapiens
MSHGPSPRLAESPQLSKGSLLTILGSPSPERMGPADSLPPTPPSGTPSPGPPPALPLPPAPALLADGDWESREELRLRELEEARARAAQMEKTMRWWSDCTANWREKWSKVRAERNRAREEVRQLRQRLDALTKELAGARRERQEAQGECEARGRELARLRGARGVADQTRDGPEPEAEREPVRDVGSERPPGSQELELVESLLKSMPEESEDCWEARSLGAGGPRGSSGRQERSRLPWEDTAATEEEASKLTALRLRLDESQKVLLKEREDKLALSRNIEKLEGELSQWKIKYEELSKTKQEMLKQLSILKEAHQDELGRMSEDLEDELGARSSMDRKMAELRGEMERLQAENAAEWGRRERLETEKLGLERENKKLRAQVGDLEEALARRRRQTASALDCDLRASQAALFEKNKELADLKHVHGKLKKQFQEKVAELAHANRRVEQHEAEVKKLRLRVEELKKELAQAEDELDEAHNQARKLQRSLDEQTEQSENLQVQLEHLQSRLRRQQQNAPLFGKIRSARFGTEEAEDGTSDLDEDEDLQIQVA

SEQ ID NO: 452 - protein, 616 aa, Canis familiaris
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKSLDAGQENNSNCNFTSRDGSISPVSSECSVVERTIPVCRESRRKRKSYIVMSPESPVKCSTQTSSPQVLNSSASYSENRNQPVDSSLAFPWTFPFGIDRRIQPDKVKQAENTRTLELPGPSETGRRMADYVTCESTKTTLPLGTEEDVRVKVERLSDEEVHEEVSQPVSVSQSSLSDQQTVPGSEQVQEDLLISPQSSSIGSVDEGVTEGLPTLQSTSSTNAHADDDDRLENVQYPYQLYIAPSTSSTERPSPNGPDRPFQCPTCGVRFTRIQNLKQHMLIHSGIKPFQCDRCGKKFTRAYSLKMHRLKHEGKRCFRCQICSATFTSFGEYKHHMRVSRHIIRKPRIYECKTCGAMFTNSGNLIVHLRSLNHEASELANYFQSSDFLVPDYLNQEQEETLVQYDLGEHSFESNSSVQMPVISQVSSTQNCESTFPLGSLGGLAEKEEEMPEQPKASACTEATRDDPPKSELSSITIE

SEQ ID NO: 453 - protein, 458 aa, Bos taurus
MELPPGPRDDPHAWDDDSDPELEPDTDAQAEAYVARLLSPPKLGLAPPRAPPLPAPTVSFGSLEPRAASKGPTVAVPGLLSLPPELLLEICAYLDARLVLHVLPRVCHALRDLVRDRVTWRLRAQRRVRAPYPVVEEEDFDWPTACIELEQHLSRWADDGRRAEYFCLADGHFASIDSVLLLQGGTLCLSGSRDRNVNLWDLQQLGVEPSRVLVKTLGTQKNSTHKGWVWSLAALDHRVCSGSWDSTVKLWDMAADGQQFGEIKGKAAVLCLSYRPDILVTGTYDKKVTVYDPRVGPALLKSRRLHSSAVLALLADDRHIISGSEDHTLVVFDRRANSVLQRLQLDSYLLCMSYQEPQLWAGDNQGLLHVFANRSGCFQLVRSFDVGHRSQITGIKHSLGALYTTSTDKTIRVHVPTDPPRTICTRSHHNVLNGICAEGNLVVAASGGLSLEVWRLQA

SEQ ID NO: 454 - protein, 1338 aa, Xenopus tropicalis
MLLLTFLFICGKPECLSAFFSMSTQTHLYQGSTMAEERSQFPLENPEATAISKPVRISRVSKSPFGTKRRILQHGIPASVPQDQKDSLITHPPHSSRSLEEWQKIAEYYVEGPRMMLVGQQSCVEELHRMEEFSSVQQQRESSVSDDEQEDKDHRDRVLFSRANSLPNISVSLVFTVSGSLQTSLSTSAPDISDHTESTFHLASDFRTSMKELEMWRHQSFMPIAVTKDDPKPSSNFAVSHGADVALAGLVRLDATTAPEETQLSYITSLKKKRSRKKKKLLDKVKLQCVYDELSQPPQALERSESLTLIPASLSYSYKEKRYSRSSSLPPKLDFSSFVRKYGGIRDKQVVREWVRDIWNTWFDEVFPPSRASSDNEQEQPYSLKEITEGATKEGILWLQDSVQPVLIEDPGASVEDLEGEIARLTVLIDEKEKPCAFHCCRRGALNRKLGKLSLAIQDLNLAINLEPQLLDAYWNRHLIFCLQGKTTAALEDLNMIIKLNKLYTDAYLSKAEIYKQEGDYTMSILSYTQALKCRPDDDEIYFRRAQMYEAQDEYKIAMDDYAKSEAPPPLPVQVSHKKKNPGSCCLQACPEGSRGRLQCFQLSQSRVDALQKHGMYCFENCNWNIAVQDFTALIKQDINNVEASSENLNAFLYRGILYIDMGLWAEAICDFERVLALDRTVVLAHMNLGLISLLNRKDYAQAIRHFTAALNVDPVYIKAYLCRAQAFQQINDLNNAMKDITRAIHLHPDSPQPYLIRGQYLYEMKKYSLASFCINYAAEMTQGSSAAQQALVQSFRQQYSNAIECLVSAIQAKPAPALVILLGKIQMKANNSKDAVKTFRDALDMFKSSNDLILSPSNKAEILFNLGLCYMEQFDFQKALEALTSAIKVRSRFHEAYYQRGLCRMHLQQAKCLDDFNKALEINPNYFQALLCRATFYGFRKRYSKAIMNCNAAIKVQPHSVRAYLYRGALKYYIKALKDYSIVLLLGGWKEVDSKVLVNRGLLYLELQDFANALEDFKCVALRTPGDIKIHLVIGNCHQRLQQYEEAVQAFNQALNITPLSAEACIGRGNAYIEYGHQRGTAQAKRDFLRALHLSPSCVAARICLGYTLQAQGLFQQAWNHFTVALDIDPQSILGFEGRAIVSLQIGDTFAALQDMNAALKLCGSAQLLTNRGVIHQFMGKLPNAMRDYQAAITADQDYSLAYFNAANLYLHNRQFTQAKEYYTRAVALDPANESAVLNRGITNMLLQDAQAALHDFQLVLSLCPVSSAAYFNRASLYNTLQQYQWAESDISQALNLQPDDPLIYKLRADIRGKLGLTKEAIEDYEHAITLLGQSAQ

SEQ ID NO: 455 - protein, 477 aa, Homo sapiens
MSVSNLSWLKKKSQSVDINAPGFNPLAGAGKQTPQASKPPAPKTPIIEEEQNNAANTQKHPSRRSELKRFYTIDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFK

SEQ ID NO: 456 - protein, 739 aa, Gallus gallus
MSKGILQVHPPICDCPGCRISSPVNRGRLAEKRTIPLPPTRIPKKELTSIFSHSDDSEESDKGNGQHPEVKQEEDLHINIMKRRIHTHWDLNISFRETSCSRDNDLSTIISNVHQSRQLVMPETQSRCEFKRNSVDVGLGAADDILGKRRVCSPNSSSECPLESKKARSESPKENSHTPLLEDSVTQMTPEEHYRRMMSALNEHSTFEEQQQQRLYQLANSMAVPSHGDLLRARQEVAAAAAARNPGAMEAHIPTGGNSSSQRRKQGLPQHRDSHFPDREISHPPPLLSPQNAPHIALGPHLRPPFLGVPSALCQTPGYGFLQPAQAEMFARQQEMLRKQNLARLEMSAEIIRQKELENLHRQRLLAGDPLSLHPGLPPDHPALRNVHDIPEGHPLRDELSRRNAMLVLRHNNAPLLSLNPGVPSSSTPPKEQPRRGSRKAAHHRAESQGPSEAKEPAEPRARDGAPDCNDEEMKDSESDADVSDEKPESLKADSGGSATELKECKETGKGCEGSKELGEGTGSQNAPCSSSSAESPSHLLGAGINKSEVKYLPPASIPPPQPLPFGFPYTMSPYFHAGTMGGLFLDGDESPALEDISKWTVEDVCSFVSNLAGCTEYTQVFREQAIDGETLPLLTEEHLLNNMGLKLGPALKIRSQVAKRVGRVLYMAGFPMAFPLQPPGLRPPERDLPPAELRPSSTGSVSSPFGSALPSASRISPKQENGNPSIGAGLSDTTKPPS

SEQ ID NO: 457 - protein, 2491 aa, Canis familiaris
MVETAAEMEAYVLEDILEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKHKVEDEPEVLTEPPSATTTTTIGISATWTTLAGSHGKRNNTITTTSSKRKNRKNKITPENVQIIFDDPLPISYSQPEKVNGESKSSSTSESGDSDNMRISSCSDESSNSNSSRKSDNHSPAVVTTTMTSKKQPSVLVTFPKEERKSVSGKASIKLSETVNEVTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNRLKSSSANSKIGSSAPTTTAANSSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNSTAPTNATYPMPTAKEHYPVSSPSSPSPPAQSGGVSRNSPLDCGTASPNKGASSSEQEAGSPPVVETTNSRLSNSSSSSGSSSVHSNQQQPPGSVSQEPRPPLQQSQVPPPEVRMTVPPLATTSSAPVAVPSTAPVTYPMPQTQMGCSQPAPKMETPAIRPPSHGTTAPHKNPAPVQNSSVAVLSVNHIKRPHSVPSSVQLPSTLSTQSACQNSVHPANKPIAPNFSTPLPFGPFSTLFENSPTSAHAFWGGSVVSSQSTPESMLSGKSSYLPNSDPLHQSDTSKAPGFRPPLQRPTPSPSGIVNMDSPYGSVTPSSTHLGNFASNLSGGQMYGPGAPLGGAPTAANFNRQHFSPLSLLTPCSSASNDSPAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERESTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 458 - protein, 491 aa, Mus musculus
MGANNGKQYGSEGKGSSSVSSDVSSSTDHTPTKAQRNVATSEDSDLSMRTLSTPSPALICPPTLPGFQNGRGSSTSSSSITGETVAMVHSPPPTRLTHPLIRLASRPQKEQASIDRLPDHSMVQIFSFLPTNQLCRCARVCRRWYNLAWDPRLWRTIRLTGETINVDRALKVLTRRLCQDTPNVCLMLETVIVSGCRRLTDRGLYTIAQCCPELRRLEVSGCYNISNEAVFDVVSLCPNLEHLDVSGCSKVTCISLTREASIKLSPLHGKQISIRYLDMTDCFVLEDEGLHTIAAHCTQLTHLYLRRCVRLTDEGLRYLVIYCTSIKELSVSDCRFVSDFGLREIAKLESRLRYLSIAHCGRITDVGIRYVAKYCSKLRYLNARGCEGITDHGVEYLAKNCTKLKSLDIGKCPLVSDTGLESLALNCFNLKRLSLKSCESITGQGLQIVAANCFDLQMLNVQDCEVSVEALRFVKRHCKRCVIEHTNPAFF

SEQ ID NO: 459 - protein, 925 aa, Mus musculus
MAVTRARAGRDATRVEAPSERPAANVSAASLCGRRGAQARGRWEPACVRSSPLLSCVLETVAAAAGSLRRANPDAASATAVAAEGKRSSLGSHHLLPRPSRGISGFSKIGPGHRVAQPSNPLPGAPGVERTQIRPLAAGPGHRSPLPPDPELAALIRRTRKKSCYLCDLPRMPWAMIWDFSEPVCRGCVNYEGADRIEFVIETARQLKRAHGCFQDGRSPGPPPPVGVKTVALSAKEAAAAAAAAQQQQQQQQQQQQQLNHVDGSTKPAVLAAPSGLERYGLSAAAAAAAAAAAVEQRSRFEYPPPPVSLGSSSHAARLPNGLGGPNGFPKPAPEEGPPELNRQSPNSSSAATSVASRRGTHSGLVTGLPNPGGGGGPQLTVPPNLLPQTLLNGPASAAVLPPPHGLGGSRGPPTPAPPGAPGGPACLGGPPGVSATVSSAPSSTSSTVAEVGVGAAGKRPGSVSSTDQERELKEKQRNAEALAELSESLRNRAEEWANKPKMVRDTLLTLAGCTPYEVRFKKDHSLLGRVFAFDAVSKPGMDYELKLFIEYPTGSGNVYSSASGVAKQMYQDCMKDFGRGLSSGFKYLEYEKKHGSGDWRLLGDLLPEAVRFFKEGVPGADMLPQPYLDASCPMLPTALVSLSRAPSAPPGTGALPPAAPTGRGAASSLRKRKASPEPPDSAESALKLGEEQQRQQWMANQSEALKLTMSAGGFAAPGHSAGGPPPPPPPLGPHSNRTTPPESAPQNGPSPMAALMSVADTLGTAHSPKDGSSVHSTTASARRNSSSPVSPASVPGQRRLASRNGDLNLQVAPPPPSAHPGMDQVHPQNIPDSPMANSGPLCCTICHERLEDTHFVQCPSVPSHKFCFPCSRESIKAQGATGEVYCPSGEKCPLVGSNVPWAFMQGEIATILAGDVKVKKERDP

SEQ ID NO: 460 - protein, 146 aa, Danio rerio
MKRIHALTIQANYELRIDLEDFENSTSFAQYGSFGVGLFSVDPDEDGYPLSIADYSGTAGDSLLKHNGMKFTTKDKDNDHSENNCASFYHGAWWYRNCHTSNLNGQYLRGQHTSYADGIEWSSWTGWQYSLKFTEMKIRPTKEENK

SEQ ID NO: 461 - protein, 488 aa, Xenopus tropicalis
MDPVSVLLSVVVCIFLFKFFYGGEKGSQNFPPGPKPLPLIGNLHMINMKKPYLTFMELAEKYGPVFSVHLGANKAVVLCGTDAVKDALINYADEFSGRPKTPLFEQTFKGNGIVFADGENWKVMRRFTISTLRDFGMGKKTIEDRIIEESCCLVETFKSHKGKPFDNTMILNAAVANIIVHILLNHRFEYQDPTLLKLIKGVNENVRNGARPIVMLYNAFPSIIQWIPGTHKRIFANTQHFFNILKEIFIEHRDQLDVNDQRDLIDTFLVKQQEEKSSSTKFFHDENLKVLIGNLFAAGMETTSTTLRWGILLMMKYPEIQKKAQDVDRVIGSAEPRLEHRKLMPYTDAVVHEIQRFANLVPNGLPHATTTDVTFRGYFIPKGTQVIPLLTSVLRDKAYFKKPEEFYPEHFLDSKGNFLKNEAFLPFSAGKRTCAGETLAKMELFLFFTKLLQNFTFQPPPGVEVQLTRGVSLTSIPLDHKICALSRS

SEQ ID NO: 462 - protein, 210 aa, Xenopus laevis
MWEPYMPVEPGLGREENFLSLEDLLMSQEKLPCCIESGFPRLGFLDKGGDSDSIPEGSKMELPLWLAKGLYDNKRRVLSVELPKIYREGWRTVFSADANVVDLHKMGPHYYGFGSQLLNFDSPENPEIAKTILQTFVGRFRRIMDSSQNAYNEDTSGLVARLDELERSLFRAGQRGLNAFQSWERGKAAQITASNLVQNYKKRKFNEADA

SEQ ID NO: 463 - protein, 219 aa, Xenopus tropicalis
THTPCPLPVGIYPPAHCLRAYTPLPTVCGHTHPLPTACGHTHPLPTACGHTHPLPADSHTFLPTACGHTPPLPTACGLTPLLPTACGHTPPRPLPAGIHTPSCPLLAGIHTPPAYCLWAYTPPAHCLRAYTPPAHCLRAYTPPPTACRLTHLPAHCLRAYTPPAHCLWAYTPPPDHCLQAYTPPPAHCLRAYTPPAHCLQAYTPPAHGHTHSPPAHCQQ

SEQ ID NO: 464 - protein, 195 aa, Xenopus tropicalis
PAVPRGAGSCPEVPGVAQGCRELPGGAGSCPEVPGVARRCRELPRGAGSCPEVPGVAQGCREFPRGAGSCPEVPGVAQVCRELPRGAGSCPEVPGVAQVCRELPRGAGSCPEVPGVAQGCRELPGGARSCPEVPGVARRCWELPGGAGSCPGVPGVAQRCRELPGGARSCPGVPGVARRCWELPRGAGSCPGVPG

SEQ ID NO: 465 - protein, 116 aa, Xenopus tropicalis
ISAINHQCILYISAIYHECILYISAIYHQCILYISAINHQCILYISAINHQCILYISAINHQYILYTSAINHPCILYISAINHQCILYISAINHQCILYISAINHQCIIYISAINH

SEQ ID NO: 466 - protein, 190 aa, Xenopus tropicalis
HRDAPIPPAIYTQCQRDAPIPIGNIPCYIHTVPTGMPPYPYPLLYTHSAHRDAPIPIGNTPCYIHTVPTGMPPYPYPLLYTHSAHRDAPIPIGNTPCYIHTCPQGCPHTPCYIHTVPTGMPPYPYPLLYTHSAHRDAPIPIPPAIYTQCPQGCTHTPCYIHTVPTGMPPYPYPLLYTHSAHRDAPIPIPP

SEQ ID NO: 467 - protein, 196 aa, Xenopus tropicalis
STSHSFSLPLQLHVTPHSVCHCNSTSHPIQSVTATPPHTPFSLPLQIHITPHSVCHCNSTSHPIQSVTATPRHTPFSLPLQLHITPHSVCHCNSTSHPIQSVTATPPHTPFSLPLQLHVTPHSVCHCNSTSHPIQSVTASPPHTPFSLPLQIHVTPHSVCHCNSTSHPIQSATATPHHTPFSLSLQLFTSSIVSMQ

SEQ ID NO: 468 - protein, 180 aa, Xenopus tropicalis
EKSTTKPPPAPQTPCPYDRCKHLEPECEEIQRKAGGNCLCPGLNGPTIAPDSPRIAEVIPGDKEISVAWCSPMSTVHGYRVLYGAPDSLLERGPILNNTYRLYAIENLLPGTSYRVCVVAFNGAGESPVNGGEVEEDDGWETGTLGPCRVLHTSSSSKSHIYLGIGVGLAILAVLGLAVL

SEQ ID NO: 469 - protein, 110 aa, Xenopus tropicalis
KPFSIRHRLTCLSQNVVYIIKCPCGLIYCGKTNRQLKDRISMHRSTIRAALDPDYDKKKVKQDISKQPIAQHWAKAKHSISSFKCMPIGCVKIPRRGGDVNCLLLQKEAF

SEQ ID NO: 470 - protein, 77 aa, Xenopus tropicalis
HTFWHKKPHIFWHKKPHTFWHKKPHTFWHKKPTLFGTKNPHTFWHKKTQIFWHKKTHTFWHKTPHTFWHKKPHTFWH

SEQ ID NO: 471 - protein, 226 aa, Homo sapiens
MSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWDD

SEQ ID NO: 472 - protein, 229 aa, Homo sapiens
MDSLDRSCQDWCDRKQHWLEIGPPDLVERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMCALTTYSEDYVPPYDYQPHAYPCQDDYSIVHRKCRSQFTDLNGSKRFGINTWHDESGIYANSDVKQKLYPLTSGPIVPI

SEQ ID NO: 473 - protein, 434 aa, Homo sapiens
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQVLVILMDVFTDVEIFCDILEAANKRGVFVCVLLDQGGVKLFQEMCDKVQISDSHLKNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPGTRSVSASSGPCSPAAPHPPPPPRFQPHQGPWGAPSPQAHLSPRPHDGPPAAVYSNLGAYRPTRLQLEQLGLVPRLTPTWRPFLQASPHF

SEQ ID NO: 474 - protein, 798 aa, Homo sapiens
PARGGAGESALLPSLPLSPPRSLPPSPRMFRYESLEDCPLDEDEDAFQGLGEEDEEIDQFNDDTFGSGAVDDDWQEAHERLAELEEKLPVAVNEQTGNGERDEMDLLGDHEENLAERLSKMVIENELEDPAIMRAVQTRPVLQPQPGSLNSSIWDGSEVLRRIRGPLLAQEMPTVSVLEYALPQRPPQGPEDDRDLSERALPRRSTSPIIGSPPVRAVPIGTPPKQMAVPSFTQQILCPKPVHVRPPMPPRYPAPYGERMSPNQLCSVPNSSLLGHPFPPSVPPVLSPLQRAQLLGGAQLQPGRMSPSQFARVPGFVGSPLAAMNPKLLQGRVGQMLPPAPGFRAFFSAPPSATPPPQQHPPGPGPHLQNLRSQAPMFRPDTTHLHPQHRRLLHQRQQQNRSQHRNLNGAGDRGSHRSSHQDHLRKDPYANLMLQREKDWVSKIQMMQLQSTDPYLDDFYYQNYFEKLEKLSAAEEIQGDGPKKERTKLITPQVAKLEHAYKPVQFEGSLGKLTVSSVNNPRKMIDAVVTSRSEDDETKEKQVRDKRRKTLVIIEKTYSLLLDVEDYERRYLLSLEEERPALMDDRKHKICSMYDNLRGKLPGQERPSDDHFVQIMCIRKGKRMVARILPFLSTEQAADILMTTARNLPFLIKKDAQDEVLPCLLSPFSLLLYHLPSVSITSLLRQLMNLPQSAATPALSNPHLTAVLQNKFGLSLLLILLSRGEDLQSSDPATESTQNNQWTEVMFMATRELLRIPQAALARPISIPTNLVSLFSRYVDRQKLNLLETKLQLVQGIR

SEQ ID NO: 475 - protein, 266 aa, Xenopus tropicalis
MSKAKVQWCLLPAGQNRIKLRCRKRIWRKRFVIMMRLILNFLLKMLLLWPLITSNQWQKTKRYARRMSSSNRGGRQRAPLNVWLEPQPAMGLIIQNVYLRLKGKLCEQEVLYWAEYGERSVCYKRKQEMNCKRCGYRMYQSCQAFTDYLCRVQGTETQYRETGFPPAIATASQQGVSDTGFSPATQTCNNSVTHIQERKCLGAVCVPELGTPGIVPNTIIGIIITGTMRERLGIPLGGDCKRKVGMGIHGSHISFLQLREKGVQGT

SEQ ID NO: 476 - protein, 224 aa, Xenopus tropicalis
MGCSDTDMGCSDTDMGCSYTDMGCSYTDMGCSDTDMGCSDTDMGCSYTDMGCSYTDMGCSDTDMGCSDTDMGCSDTDMGCSYIDMGCSDTDMGCCSLVGTAEGIVDEDRFPTLVGGTDLEVRPSHTLPSCNAHLEHRKWISRCGAAECDVSSIITDEPQEGRTDTGMPNCEIKQRNKVISTSKSGSCEIKNVKLYDQSSKAIAVNTKSRLKALMRNRIIIEGLH

SEQ ID NO: 477 - protein, 298 aa, Xenopus tropicalis
MEELPPTLGKRKPVARGRGRVLAVATKPSPPTKEHPAEESKEWATDGTTTIWVDKSDQSPSYTAVMSDRPPAEPALSLPTVLLRGAVPGLNQAYWVLPGPGDPAKMRSVSRVQRMINTHVRDLWGYCMPYAPGWVFDEVEKRVQEWLYGEIIRQTDIVKEGVFHSDPERRGRDVEFVALIYLRAQSTSPRSQVESEELPSTSSSGKRKRQQEGRLRQLKFSEFENEALVEGLVPVYPSLIGKYATKMPTARKTKAWKDIAEHVNSVGVCLRNVHQCKKRYQDIKRGLKKKLAEESRYR

SEQ ID NO: 478 - protein, 324 aa, Xenopus tropicalis
MAGEVQSETFIHHPESSFETCVKSSPIISYHQSSLDLIVNHHQTSSSAVIINHHQTSSSTIISHHQTSSSTIISHHRTPSSDVIINHHQSSYVIIKNHQTPSSDVIINHHQTSSSTIIRRHHQPSSDAIIRRHHQPSSDAIINHHQTPSSAIIRRHHQPSSDAIINHHQTPSSVIICHHQTPSSDVIINHHQPSSDAIIRRHHQPSSDAIINHHQTPSSTIIRRHHQPSSDVIINHLQTSSSTIISHHQPSSTIINHHQMSSSDAIINPQPSSTSIIHGHRNLTFINKPMSGQIYLWCIGGHKKGVSATRVVIVMHGCCHKQGH

SEQ ID NO: 479 - protein, 403 aa, Xenopus tropicalis
MAKQAEGQKQSQKANQAKGQNLSQKAKQAKGQASQRPEPSKPKARAKQAKGQSQASQRPEPSKPKARAKQAKGQSQASQRPEPEPSGQASQRPEPEPSKPKARIRANGQASQRPEPGQRSHQRPKPMAALIYRYQAMPSRSTSRCIYSMLFLMLTMGLPFMKLVLADEPSGTTIPPESIVYWWQWHLLGFHVFCAGCSLVHQWLLYRMERQWDASREQGVLSQAETALIYRYQAMPSRSTSRCIYSMLFLMLTMGLPFMKLVLADEPSGTTIPPETRPCVDCQAFEFMQRALQDIKKTAYNLDSQGVNETQLYGYQWGDEDPPGPLAPKAGHTRGDLTMFRTTIGRTKHRKIRHTPFRAESAAGHTRGDLTMFRTTIGRTKHRKIRHTPFRAESAGCPYVTVL

SEQ ID NO: 480 - protein, 383 aa, Xenopus tropicalis
MNPTFYKEEQKFEWTGNLEATEPNVYNRRRSQANENVCIMIYQRNICKYISVYIRTEYTIKTSPALNTKVAIICESRNGYDKVATIHESYNGNEKVATILQRHNCNENVATVLQRHNGNEKVATILQRHNGNEKVATILQRHNGNEKVATIPEICYGYGKVATIRASRTGYEKVATIYGKVVTAMKKIAKNTKKSQNVKVFQVYCYFWTFLVLDYKGDIFRNYPHMWTTCWQSLRNTEIQKGPLQTPQAKMTSQTGPGPETTSLLCIKDPTLPRTVTGQLTKQSRPSPNPQLSLQQLSIVTHNFIWIKKLSNHALMTPGPTLQREEEAETQADKNKMKKGHSRLTRSPQGNPSERKQPLNAMLGIKVPVYEPYNSPHHNPESK

SEQ ID NO: 481 - protein, 468 aa, Xenopus tropicalis
MASSWLIAVDTRVLTVVSQLQASCTDMSEEEIAKLGVSLFNCQAEVEGRPTFPCTEDMTLAECTKPMDPDTWNAYHIVSNRARSVCYATRQLHFRRRTELTVNTLVSTAMSQLEAMKLLKDGQEELKELTSESLQKVVSSQNELLGQQELLQNNQEKMENSINGNLEMLAEEKALIASGHHLVAQLIEGITKKMENVSSQLVEQDTELQEGHRAILADLTEVRSRSQAVYNKIGMNLSAIYTCVLHGAYFLVLALLMTFLQTRGFSRAVLLLLVLLNALSELNHRLSLGFRSLTVLLVCVVIANWMLVNFIRGLVKFRSRRKHKALPPPHIGAVSESCKAGGKGYCSSTPERACDLTLLKEELRELEEKDLHDSSLLENESLLKDDSIVASSAPMNWKAQQSLMKTPNHSSPAMKLRRLSVSRSVRGSETPAKQGALDKVPQRHLGAVFDALSSSKSYSPNSSMCSNA

SEQ ID NO: 482 - protein, 278 aa, Canis familiaris
MADLPDGPVADGAQRSSSSSSPGGPQPRARASGSQPERGRAAHVEHGDQQAELSGSKKNETTFITKWIRYLRGQETSSGQYGSDARRQAESTRVPDEELNALQSFCAVKINLIQHRANSKEKKSSGRQKPQLRLEAGASEGDALTCTVPDELVNRIYLKNMRTAPKQGATAKQHISWRCLHCNRKRAELAQAAFLRRKKTLLESLLLQDKIDKHLYTKDLLTLIGDAHRGLPRLSDDPRIIWKRLNEQSQIRHSERSDTEQVWRNETRACHLNLFSTT

SEQ ID NO: 483 - protein, 570 aa, Xenopus laevis
MTETQHIFRLTVHRFMDFPLSIYSSFTQLKPTPGLKKIIAVAAISGVSLIFLACHLKRKRGKKKINAPQTEPGQFILQCSRHVAEKGSSCSSSRQNLTLSLGSIKERGSQSHLNGDLCSKYSGSMQSLASVQSCHSCACINSNSWDKTDEDEINIPVTTPENLYLMGMELFEEALRRWEQALTFRSRQAEDEANCSSIKLGAGDAIAEENIEDVISADFIHKLEALLQRAYRLQEEFEATLGASDPASLANDIDKDTDITVMDNGGDFQQRDTLSIASTDSFLSAAELADNQDMRATCGLDSLYHHALYEEAMQLAEEGKVHCRVLRTEMLECLGDSDFLAKLHCIRQAFQEIILQRENRIFLMGTGRKLLSALIVKARKNPKKFEDAYFDMMSFLEQPESWDTVEKELLSRGMKCMNFYDIVLDFIVMDSLEDLENPPLSIQNVVRNRWLNSSFKETAVTSSCWSVLRQKKQEMKVPNGFFANFYTVCEQLCPVLAWGFLGPRSSLHDLCCFYKAQIMYFLKDIFDFEKVRYSDVEHLAEDIMKCLQRRTELTVVYTGEESARRPPVLN

SEQ ID NO: 484 - protein, 623 aa, Gallus gallus
MATVLSRALKLPGKKSPDLGEYDPLTQADSDESEDDLVLNIQKNGGVKNGKSPPEEMQDPDSDVEVGMTKQHTSERAPEGYPAEAAGSLEQKAAPSLMPYLRTAVFLLTVVISMILVLVCAFLIPCPPRDLHNTWNHNLGQGAGGVLSPLELCDVNGDGLPDILIVFTALMNASVMGVSTPSVTVVALSGMNGSTLWSIQLPEETRSVQCKGLSLGSPAEPICLVTGTAKFLSLLSASTGKTIWTLNSIHLSDGILAAPAATLPDVDGDGIRDIVVLALKETQPDVFFVLVSGKTGAALGGPVKYNVIGEGKVIGPQVHITSRGAIYILFGFGNVQAIALRDIFTQARNRDSFPMMLHQEEPEWEKRRSVNLSELIDIYSGGVDFLQTIKAPDTNCSNLLITTKEGLILLQGQDLEPRWTLEIQNISSQPVLGYFSADQTLDFMLQAQTGNGKKKVVVVDGKSGLPVWKQELPWQKQQLDALSVMTLDKKSVFLFWADEAQPVLHSLHPGPRSERPGLHHLYLLHPVFPTVLLDLTNATDKVIASAVGINDLQKDAFHITVTTTATSEKQPGFLSVSKLGLKWAMMTQGRMVWLKDTTTPKISRGEVRRFLARLKFVDFPHKL

SEQ ID NO: 485 - protein, 461 aa, Homo sapiens [sequence omitted]

SEQ ID NO: 486 - protein, 459 aa, Homo sapiens
MTVELWLRLRGKGLAMLHVTRGVWGSRVRVWPLLPALLGPPRALSSLAAKMGEYRKMWNPREPRDWAQQYRERFIPFSKEQLLRLLIQEFHSSPAEKAALEAFSAHVDFCTLFHYHQILARLQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 487 - protein, 1338 aa, Tetraodon nigroviridis
YRLETFTETRTSSWNFEVYNGQPVDGAQFGDCPPPWEVSLPAPQMFTDKVETRRVPHSSIVKVQTRTEVSNRVLGPGTIPLDGPHRSCGMCNGKGYQTSPRNYNRPSTTRTCYSCNGRGRKRFLLPRLSVGGGAGPPLNPSLSARKNNVSHFIPDRQPDFPDQKFEKVSGEAFFRDENLLVYPLQGFPDLELCDVSSRLIHEHLQRFSSTSRILQQRQTIELVPLTQARYQYKDKDYSFFVYGVENKRRSLEPGIVRAGREGTADRTGAGLSAESGGSTRTCSVCPGSSSRWPSRPLPVVPGAAGTRLGVGCLCVSSTNSSDRKQAANLRNGSALFWKGGVSDALLLDEDGGWLLVGGKDHIYLLQPDSLEVAAATVSWPAPREHVERCRLAGKSPEVSVRFCPAHLATASTPDFLSARCQTDCANFVRLLQPFNKTHVYACGTGAFHPQCTYVHVSFNAQEPSLVLSRVVESGRGKCPFSPREPFTAQLTGGELYSGTSVDFMGANSGIFRTSRLYIRTEAYDRHWLNGERRPPALHGCPPQLIFSSSSSSEPTFVSSFSVPDTHSADDDKVYFFFKETAVEGEQWDRRRHSRVARVCKVADVPEVDAVLHRPAAGRWLTLLLLLSLSPPVSCQNDVGGRRSLINRWTTFLKARLLCSVPGPSGVDTHFDELEDIFVLETKDPQNPTIYGVFSTSSSVFAGSAVCVYSMASIRAAFNGPFAHKEGPEHRWVEFRGRVPYPRPGTVSTHTHAQIHTHRYTHSDTHTQIHTLRYTHSDTHTHRYTHAEIHTHRYTHTQIHTLRYTYAQIHTHRYTHSDTHTHRYTHTQIHTLRYTHAQIHTRTDTHTHRDTHTHRYTRTEIHTRTDTHTHRYTHAQIHTLRYTHAQIHTRTDTHTQIHTRRYTHAQIHTRTDTHTQIHTHSLGLAGLGLANSSPPPTCLVPPTRPQCPSQTYDALLRSTLDFSDQLVSFVRQHQLMWEPVRPLGGRALLSRTRGQHAFRRLVVDRVDTEDRTYEVLHLGTDDGKVLKVVTGGTEDVLLEELDVFQSPSPVLRMALSTKRSDTLLLSLSVCPLQQQLYVSSELGVVQLGLQRCRFYGSSCAECCLARDPYCSWDGQTCSGFLTPNKSRARRQDVRYQDPWTQCPVTEDEPLEVKVVYGVEGNSSFLECLGRWPQAELRWTFQRTEKQHQGGGWSRDSREMPLRGDEDHLVLMGRGLLLRHLQLAHSGVFTCTSHERSFSQALARYRLHVIASDALQPGHRLQQSQVLLGQAAVSPPLPAPRKSWLPPQLPARSLKHGLGTSQDVHEDCEQLWQREKRRQQKLRTLKQKQEIRRARVRRNN

SEQ ID NO: 488 - protein, 1357 aa, Drosophila melanogaster
MWRLHLFLLLSTCFLVPHDAKPTKRSPVGFSSTTLVSLLLETETGNGTTDVPTTTETTTLRTQRVTNIGRLASKDLADLLLASMQARGAKLTSSQESTMKSLRTEEGKDTKGNNVFLQIGMDVIIDILIGARDNATCGRIIQDIDQSQDRNTLTLTLKSFLALCVFNGIECAKDEVSQVIKSTHFRQKQQIKIVHDDNDHQQSEGSGLRTARRVGVIKDDRNSVLKFLQARNIKELSTILNTLLKLCGASGGEAHKIIRNLREMGPDNVSLLQVNAFSMLSVSLLDSLSTIAEGKISGLCSASPESWIVRLLAMGVDKVVLMGLMTALDRTIVNSSSAEMTNAAALNSINGGDFSNSKSKVDQKTAAKRAILDSGSGNDFNLAPSVEEIGNLNTVNDLINANVPVGANLPVLSTIDGSSSSGNTLNQSSDVVLDGDSNNFNRLVGAKIPVLANAPILSNINGGSGSGGVGNNFNLAPSVQEIGDSNTVNDLINANVPVGASLPVLSSIDGSGFSGNTLNQGTDVLVNGTGNTFNRLVGARIPVLANAPILSSINSGSSGTSGSSSSGSSSSGSSSSSSGSSSGVGNNFNLAPSVQEIGDSNTVNDLINANVPVGASLPVLSSITGSGFTGNTLNQGSDVLINGTGNTFTRLVGARIPVLANAPILSSINSGSSSTSSGSSSSGSSTSSGSSGSSTSGSSGSGSTSSSSGTPSSSGSSVLGNNVNVKGDTITGNKNFLFKLLDLGLPISLAAPVLSIINQGSSTGSSTGSSTSSSTGSSTGTSSGSSTGSSSGSSGVTSTGSSNSTSSGASVGNNANIDPSVDIVGNNNQVTKVVDANVDALANVPVLSKITGTGFANNLNQKSNVLIRGDNNTVTKVVDANVPVLAAVSALSSITGKSSGSGSSSGSSGSGSSSGSSGSGSSSGSSGSGSSSSGLLSGLTGSSGSSSDGLLGGVLGGVVPVVGEVVGDVVQAVGPVLGGVLNTVEPVLGGVLNTVEPVLGGVLNTVEPVLGGVLNTVEPVLGGVLNTVEPVVGDLVGGVLSGVTGSSSSSSSSLSGVTNLLGGSSSSNGSSSIIGNSASSGANTLITGNNNNIVRLVDVNGLVLADIPILSSITNLLGVTGLIGNSANKGPKTVVIGDNNRIVKLINVDLWVLAFLDVLNIVRGSGGVCNQLNSGPNTEIIGNNNDVVQLVDVDLSVLLVVDLLSHLITNVANDCSGKTTTVAPTQSPTESPTESPTGSPTDSPTQSPTETPTYGPPTNEPPTNQPPTNQPPTVQPPTNQPPTNQPPTNQPPTNQPPTNQPPTNQPPTNQPPTNEPPTNRPPSPSPNNCYRRYCRKWRTRPSYLCYKNCGGAFVYKP

SEQ ID NO: 489 - protein, 178 aa, Xenopus tropicalis
MEQQLAIMHAKLREELPDFLLKSMDYSIYRKDVEFVCSVLHIHTRGIILYQLLLTLSRFLFLSYLSNASVSILKLTSHPETCSIQARWAISGLPLHTLLFHFYRTDKTELYKSFDAHSTFYVASDGLIHLHKLERVMPSQPLTVPKKTLLTAALVALGLGENRPALNLLSSPKASPKL

SEQ ID NO: 490 - protein, 213 aa, Xenopus laevis
MAPRKSTRQDKKPKRTPPVLTPEQKKKRAFQRAQLEEEMKIMSSGNHADNCLLYEPVLRERAQRQSCQPPATVRVGNTNWCVCGHCCPMPTEEESICCMEIENLQGIVTEDITCITEHPQFDEYCQNKSNLKMCLLFSGKWRTQRTPEHNREFRKAAYRLFTRWIHGFLGPKHRRPIPSCVVRKVRNIFLEHNNRYTGFYVSSDYCAADMADE

SEQ ID NO: 491 - protein, 1984 aa, Macaca mulatta
MTLMDVDEHYHWIARMEMLPDTLKAIEKNVKILSRFSTAFLDEKKKQKKKILSRGTLWKSWKERVIKRPSTAHALRPDQMISDQFATNTKVSEIQGMLQELKGTTMFSTLENSAIKYISSTIVNLSKALSMLNDELKGVNFQSSTVCVQETSEAEKELSLKVIQDLSNENEMLQQKLHDAEEKCEQLIRSKIVTEQAYAILSTSSTLKVLPGPSPQSSRAIIKVGDIEDNMDNILDKDLENIVDEVQRKETKDSGIKWESSISYIAQAERTPDLTELQQQPVASEDISEDSTKDNVSLKEGDVYQEDEIDEYQSWKRKHTKGTHVSETSGPNLSDNKGGQRVSEAKLSQYYELQALKKKRKEMKSFPEDKSKSPTEAKRKHLFLTETKSQGGKSGTSMMLEQFRMVKRESPFDKRPTAAEFKVEPTIESLDKEGEGEISSLVEPLNMIQFDDTAEPQKGKIKGKKHRISSGTTTSKEETTEEKEVLTKQVKSHRLVKSLSRVAKETSESTRVLESPDGESEQSNLEEFQKAIMAFLKQKIDNTGKPFDKKTVPKEEALLKRTEAEKLGIIKAKMEEYFQKVAETVTKILRKYKEIKKEERVGEKPIKQKKVVSFMPGLHFQKSPISAKSESSTFLSHESTDPVINNLMQMILAEIESERDIPTVSAVQKDHKETEKQRREQYSQEGQEQMSGMSLKQQFLEERNLLKERYEKISENWEEKKAQLQMKEGKQEQQKQKQWQKEEMWKKEQKQTTPKQAEREEKQKQRGQEEEELSKSSLQRLEEGTRKMKAQGLLLEKENGQMRQIEKEQAQELGIPLTPQQAQELGIPLTPQQAQELGIPLTPQQAQELGIPLTPQQAQELGIPLTPQQAQELGIPLTPQQAQELGVTLTPQQAQELGIPLTPQQAQELGIPLTPQQAQELGIPLTPQQSQALGIPLTPQQAQELGIPLTPQQAQALGIPLSLQQAQELGIPLTPQQAQALGIPLTPQQAQELGIPLTPQQAQSQGIPLTPQQAQELGIPLTPQQAQSQGIPLIPLQAQELGIPLTPQQAQALGIPLTLQQAQELGIPLTPQQAQALGIPLTPQQAQELGIHLTPQQAQSQGIPLTPQQAQELGIPLTPQQAQSQGIPLTPQQAQALGIPLTPQQAQELGIPLTPQQMQAQGITLTPQQAQALGIPLTPQQAQALGIPLTPQQMQAQGITLTPQQAQALGIPLTPQQAQELGIPLTRQQAQAQGITVTPQQAQALGIPLTPQQAQALGVPITPVNAWVSAVTLTPEQTQVLESPINLEQAQEQLSKLGVPLTLDKAHTLGSPLTLKEVQWSHKPFQKPKASLPTGQSIISRLSPSLRLSLASSVPTPEKSSILPISRVPLNQGPFPPGKPLEMGILSEPGKLGAPQTLRSSGQTLVYGGQSTSVQFPAPQAPPTPGQLPKFGAPPTPGQPFELEAFSSRELFITRASLTPPPPQMSNAPLAPRQRLIAGVPPTSGQIPSLWAPLSPGQRLVPEASSIPGDLLESGPLTFSEQLQEFQPPATVEQSPYLQAPTSGQHLAPWTLPGLASSLWIPPTSRHPPTLWPSPAPGKPQKGWSPSVAKKRSAIISSLTSKSALIHPRAPAFKVAQVPFTTKKFQMPEVSDTSEETQILRDPFAMESFRTFQSHLTKYRTPVSQTPYTGEGALPTLMKPTSLSSLTTLLKTSQISPLEWYQKSRFPPIDKPWILSSVSGTKKPKIMVPPSSPQELEEKRYFVDVEAQKKNLILLNQAIKTCGLPSQLHTTARTLIIEILHTDTVQLGYLFRKYIAYRLIQYARNNIMKRLKAIQNTGKGYEARNLHVMLSRLDDYRKKVMQVWTEKQKSLGKKRNQCLKKMIHVFNQLKKIYELNLSQPIPLIVEEKQIPAATTFVQKPFLKLLVEEDRTSDIFKKFRQQEDQTQPIWNVDLSTSSYPIAEKTSMHSLWAQLGGYPDIPRLLQLEVQSTFRKSLASLQSHSSG

SEQ ID NO: 492 - protein, 269 aa, Gallus gallus
VHDTNMRAKGHPERVFSVSSGPPPALPPTFVQRHHSHLVPPVPSEYLHPSATSPIEYPHPSATSPIEYPHPSATSPIRIPPYHATSPIEYPHPSATSPIEYPHPSATSPIRIPPYHATSPIEYPHPSATSPIEYPHPSATSPIEYPHPSATSPIQIPPPQCHQSHPNTPIPVTHIKTIKREDELIEIQADTGAWHRRWLVRCLSLSQQVWSNFQQCFAPEYRRITLMMMAVWFTMSFSYYGLTVWFPDMIKHLQNIDYASRTKLFTREK

SEQ ID NO: 493 - protein, 619 aa, Xenopus laevis
MKKFGGPGRMKQSCLKRQCTAPVLPHTAVCLLCGDAGKEDTAQEEEQKFNLSLMECTICNEIVHPGCIKMGKSEAVINTEIPNCWECPKCKREGRTSKDSLDSSGKRRLDNGEDAVRWKLTDDPAPGKKKSSDENAGHKRKKEQGPQSETGVKKKVKAEKDKKVKKIEPPVPADPVPPPDRSHQREKIERFKQMCQMLERARSSTSSSSSDSDSDSDSKGSRGSSDTGGDGGESRISFSTSSEEEEEEGGTGDGRNGTRNGKPKPPRANWREKENRRGSGVGNNRKGITGRNTGQAISRTQLLKRPLVPSPPKPAPPQLERHVVRPPPHSPEPDSLPLDGGTDHVMQRGVWLSVFRHLGQKELCVCMRVCRTWNRWCCDRRLWTSIDLSRRKSITPPMLSGIVRRQPIRLDLSWTNISEKQLTWLIHRLQGLKELLVCGCTWSAVSSLCTASFPCLSLLDLGWVQGMKTSHLRELLSPPSSDCRTVVPDPRGRLPSLSELRLCGLEIGDSALRLLLRHTPRLHRLDLSHCVQLTDHGIHILTAASTLRDSLTHLNLTGCHRLTDQSLAFFKRCPHLQLVDPPLSRSAPHVRGEPGAKSFVDDLILGQGFVRSRAATSLR

SEQ ID NO: 494 - protein, 443 aa, Yarrowia lipolytica CLIB122
MSYNQGYNQGGYNQGPPQGYNQGGYNQGPPPQSYNQPPQGYNQGPPQHGGYNQGGYNQGGYNQGPPQHGGYNQGPPQHGGYNQGPPQHGGYNQGPPQHQQGGYQQGGYGGAPPPQHGGYGGAPPPQQFNQGPPPQHNPPYDPSNDASVLYHAMKGWGTDEKKLIQVMGSLKAYQVAPLNNFYRQKYGKTLQKHLTSETSGDFQFALEALCYTPPEFDAFCVHHAVRGLGTKENWLDEILLCRSNYEMQQIKNAYQFLFKKDMVQDVLSDLSFKTKQMFEIVLNRQDINRPVDPNRVQQDVYELHKAFKGLGTDEVQVMGILCNRSQAEVAAINAQFHATYAKRLVHALESEFSGHMENALTFIVKYSTDKYQCQAEYLEKAMAGPGTDERALTNRIVRLHWDQQGKPQVMRAYQNVYKRDLVSRVKGETSGDYERLLVALLQN

SEQ ID NO: 495 - protein, 365 aa, Canis familiaris
MVDAWHALALRHLILLLRYAESPPVGVFAGKDFFFLTPLGWSTGQHVDSANPQPTSCSTQHLDSANPQTTSCSTQHLDSANQVLNSTPRLSQPSANQVLNSTPRLSQPSANQILNSTPRLSQPSANQLLNSTPRLSQPSANQLLNSTPRLSQPSANQVLNSTPRLSQPSANRVLNSTPRLSQPSANRVLNSTPRLSQPSANRVLNSTPRLSQPSANQVLPSGNARRWTAVAQRAVLLLRAPAARGTCSPRAPAPAARGHLQPEGTCTCGPGAPAARGHLQPKGTGTCGPRAPAARGPAGKNKGKTTTRVHPSVLLEALGPGTCHGATGGRRRCPDPSTSGTSGDTPPGTYPGTPDGKGTAKQQPN

SEQ ID NO: 496 - protein, 325 aa, Homo sapiens
MPSRILDKELLSGIPDTERLSEVVDNRAPQRDPTHRAPQRDPTHRAPQRDPTHRAPQRDPTHRAPQRDPTHRAPQRDPTHRPPQRDPTHRAPQRDPTHRAPQRDPTHRAPQRGPRHRAPQRSPRHRAPQRDPTHRAPQRGPRHRAPQRDPTHRAPQRGPRHRAPQRGPTHRAPQRGPRHRAPQRGPRHRAPQRGPTHRAPQRDPGWRAPQRGPTHRAPQRILDAEPVSGFLDAESLSGILVVERLSGILDAERLSGILDTERLSLVLHTERLSGILVGERLSGVLHTERLSGILVGERLSGILDTERLSGILDTEPLSESQIHSA

SEQ ID NO: 497 - protein, 445 aa, Xenopus laevis
MREIVHLQIGQCGNQIGSKFWEVISDEHGINNHGSYEGNSHLQLERLNVYFNEAHSQKYVPRAVLVDLEPGTMDSLRSSSIGPLFRPDSFVHGNSGAGNNWAKGHYTEGAELIESVMDVVRSESESCDCLQGFQLVHSLGGGTGSGMGTLLINKIREEYPDRIMNTYSIMPSPKVSDTVVEPYNAILSIHQLIENTDETFCIDNEALYDICFRTLKLTNPTYGDLNHLVSMTMSGVTTSLRFPGQLNADLRKLAVNMVPFPRLHFFMTSCAPLTSRRSQQYKAVTVAELTQQMFDARSMMTACDPRHGRYLTVAGIFRGLMSTKEVDEQMLSMQTKNSAYFVEWIPNNVKVAVCDIPPRGLKLASTFIGNNTAIQEIFRRIAEQFSAMYRRKAFLHWYTGEGMDEMEFTEAECNTHDLIAEYQQYQEATAEMEEYFEEEEEVAEE

SEQ ID NO: 498 - protein, 472 aa, Xenopus tropicalis
MPQNRSMESQAYSLPLILPDLRREEAIHQITDTLQHLQTVSNDIFSRILQRVETNRGQLQRINGRLSLAQAKIERLKGIKKAIKVFSSAKYPAPEHLQEYSSVFAGAEDGWLAKKLRHKIQSKHRPLDEQAVQEKLKYFPVCVNTRGQDEESAEEGLGSLPRNISSVSSLLLFNTTENLYKKYVFLDPLAGVVTRTNPALEGEDEEKLFDAPLSITKREQLERQTAENYFYVPDLGQVPEIDVPYSLPDLPGVADDLMYSADLGPGIAPSAPGVPIPELPTFITEDITENSRTDSQDGRLLPPPPPPPPPPPPPPPPEPSVLSPPTSLAPPLPIPAPARVGSSDVGDPGSLQGAPKEVVNPSDGRASLLESIRQAGGIGKAKLRNVKEKKLEKKKMKEQEQVRATGGGGDLMSDLFNKLAMRRKGISGKGPAAGEASGDGPTGAFARISDTIPPLPPPDQASGDGDEEDWES

SEQ ID NO: 499 - protein, 442 aa, Xenopus tropicalis
LRSHLNRPMKCLTVMWAVGQAGFTDLAEGLKVWLGLMFPVLGVKNLSPYAILYLDRLLLAHSNLTKGFGMGPKDFFPILDFAFMPNNSLTPSQQENLRSLYPRLKVLAFGANPESTLHTYFPSFLSRATPSCPAAMRKELIQSLSDCLNKDPLSFSVWRQLYTKHLAQSSLLLQHLVETWDGNSRSMRKSLRETVHSFKVTNGEFSGKGTNSKDLEACDAACQALLLKMRGGGFPWRRLILIGFVFAFGFVFYDIRTHDSFQASTSAKLLHQSGLLSVSQQAWSRVSNYSLQGQSWLERNVPQYYSQAVEVLGPALEQMWAKTQEGSAYACEKGSALIAYAQDNLPRLLEWLHSSLPDSVFHFIEYLRELLLHLHRTYLLPAATYTEAAVQSAWERYVQSCKKVTWDCVRGQVGNLSRSSWTYLQNATLTVTNWALSIISQH

SEQ ID NO: 500 - protein, 2408 aa, Xenopus laevis
MQNLEAQVTGSLVAFPDVTQKALKEDEINLDSVLRGKFSTGRTSLAWLACGPQLEITNSVTGERISAYHFSGLTERPPVVVAVKEFTWQKKTGLLVGLVEAEGSVLCLYDIGISKVVKAVVLPGSVTAVEPIINHGGASASTQHLHQSLRWFFGVTAVVTDVGHVLLIDLCLDEVSSNQDELDASDLEVMSVIPTKIPKLREAATRERRHLCLQLAAPTGTTVSCLSYISRTNQLAVGYSDGYFSLWNMKTLRRDYHVQIEGGRVPVCAVAFQEPENDPRNCCYLWAVQSSESGGDVSLHLLQLAFSDRKCLASGQIMYELLEYCEERYSLDLSGSTLSLRGQSNNTKLLGCQTIEKFRVHGEREDGVHEVTSPDTSVSVFSWQVNTYGQGKPSVYLGVFDINRWYQAQMPDSLRSGQFLRNCSYFAFWSLEAVVNITTQDIIFDILVHERSLSRGIPPSYPPPEQFYYPSTYNFDATCLLNSGLIHFACTGFQKETLHFLKKSGSSLNEAIPDGYNRCLAAGLLAPKFTDVQASSLSQEEQLQAILAAAVETSSLGLLTSCIKRWTAEEQPRSAANLRFVLEWTWKKVTLTKQEFDRLCFRLFDGSCNFIDPHTLQSLQQCHLYFSNLTAVLNCFIAQAKEVTQQGAVDLTNKQSVTRLLTLYASVVLWFCRSGMLPDSSDETVQLTRPFYNYQVIQQYYSDQRKKLERLARGKWDTSSLMIDGLINQFGDRIQQLWSRDDNGTGKYPPANLHALLDVYLLENADEMSKHAITIYFLLDIMYSFPDKPDSSIESFPTAFFVPGSLIKLIQGFWLLDHNDYQNSVDCILNPASSRVMSWQHSQIIENLLCHGDSRQALRYLQVMKPVATTSKEVKLHMTVLLANRSILEAWNLQRLHSSRLNVEELLKHMYEMCQEMGLIEELLKLTFTDFEQGYLHKFLQTTGVQNQELLLVHHLQRANYISALQLNQSLKTNHLNDCDRRLRERSGARNAILDQYGKILPRVQRTLASERAKPYSLPSLVWREVARPKPLSTTAKQAAPGSIITKANFICNVLSKIKEVSTANEKREEYSPYQSMVSEEPTAPPLQDIDVPDAFFGTPINKSRRVSRLLDSVVHPVLMEPTPLTSSDTDNNQTPHKSPLLKTSSPLHSSLRRIAHMRSFAKASEFSLLETPLVVRKAKALAANTASSGYTSITPQSILRSSVRTTPLVSPSVSPGRSLTPPLRPKETKISFMELSFTRHAKAAHSSEGNLLAISPVLRSSPDAVWSVKGKVASFTQNTPVKKLDEIDASSSGIQEESQDEMEVSKEISNISVRSEQASLEYHDAPTPEDLENDEISGTTNSQPQVNEVHHQMEDGQLTEKPAELALTEMQEEFIDSEEREIEYISAPLNGPNALECMTAVPDIYLEDASQCILETPEGSSVSVTGEQECVSSAKDSESVISIHDSDDAHSNLSENDQDSEEIEENNLRVPTTVTRCEEFDLIETKDLEVELEEADSEKTNYKDIYPDATVQLGFTVESIEQRYTCELADRRETPSETDEIEGEHFETENNFSLVLEGDVTEEEILEPSSSKTDLELTRPPIAHQKLISENRENIENCETTEKIPANMSPLVDSDHESKTLETLPSEADLSVAEKVLKGTEEKDVPPEVHSEVVLESKLVGNAMMSLDSSESQEVIISQYDNVISIEKLEMTQEKMYGEKTEQINEGQVSPNRDQSTLVKPLTPRRSIRKSSKPADSSTDIIGNITLPTTPKRGLKKAKENVDTLKNSISVVPEEELTLGTRRITRKATLTALDNPEPLQIKEPPSGEDLQVQPSTPTRGRRGKVITSDDLKEPPSGEDLQVQPSTPTRGRRGRVITSDDLREPPPGEDLQVQPSTPTRGRRGRVITSDDIKESPSVEDLQVQPSTPTRGRRGKVITSDDIKEPPSVEDLQVQPSTPTRGRKGKVITSDDIKEPLSGEDLQVQPSTPTRGRKGKVITSDDIKEPLSEEVLQEQPSTPTRGRRGRVITSDGKGYECVEEKNALPLTPTRITRSKNILEPEKGISQIEPEKGISQIEPDKGLSQIEDTGETEHEVVTPRRGRRGKRVVNELVKHFERNSSQPNIKADTSPPVSPKKVSLRWTRTRSENQRINATEEQASKIQEDLSDTPRKRYKKSSNKMGFEETTDTVTEGAIVEDVQESLIISHLGKNPNTSIVRSARKTALPPVTEDHSEQPLLPPESHSKVHSSLAIADEENKTNTRTRSGNKSSVDVSAITFEFSTPKARTKKTAKGSAVPTELIPSTQYVFSPPSTRTRRATRANVSEAVIEPQLQFQESCEIAETEVPEVPASKPRGRPPKHKAKAVTRVLKKPSWSTPPVEIKLISPPESPAVSETNTKTDSTEAKGAEKISVRRTRRRIIAKPVTRRKMR

SEQ ID NO: 501 - protein, 209 aa, Mus musculus
MAKDLDELLDEVETKFCRLDPLRLDLGERPKGDGGGGSHSGDRNGAQEKETLRSTETFKKEDDLDSLINEIFEEPDFDRKSFQKFKSKSSSNTCVRAPMQGVSKSCSPVYLSGSAIPCGIGTNTSQRACDRLRCVACDFRIVSYNDYMWDKSCDYLFFRNNMPEFHKLKTKLIEKKGARAYACQCSWRTVEELTDLQTDHQLRWVCGKH

SEQ ID NO: 502 - protein, 1236 aa, Macaca mulatta
MENCSAASTFLTDSLELELGTEWCKPPYFSCAVDNRGEGKHFSGESYLCSGALKRLILNLDPLPTNFEEDTLEIFGIQWVTETALVNSSRELFHLFRQQLYNLETLLQSSCDFGKVSTLHCKADNIRQQCVLFLHYVKVFIFRYLKVHNAESHVPVHPYEALEAQLPSLLIDELHGLLLYIGHLSKLPSINIGAFVNQNQIKLFPPSWHLLHLHLDIHWLVLEILYMLGEKLKQVVYGHQFMNLASDSLTNVSLFEEHCETLLCDLISLSLNRYDKVRPSESLMSDQCPCLCIKELWVLLIHLLDHRSKWSVSESFWNWLNKLLKTLLEKSSDQRRPSVPVIQSRDPLGFSWWIITHVASFYQFDRHGVPDEMRKVESNWNFVEELLKKSISVQGSILEEQLRMYLHCCLTLCDFWEPNIAIVTILWEYYSKNLNSSFSISWLPFKGLANTMKSPLSMLEMVKTCCCDKQDQDLYKSSSSYILFLCILAKVVKKAMKSNGPHPWKQVKGRIYSKFHQKRMEELTEVGLQNFFSLFLLLAAVAEVEDVASHVLDLLNFLKPAFITSQRALIWKGHMAFLLMYAQKNVDIGVLAEKFSCAFREKAKEFLVSKNEEMIQRQTLWTLLSIYIDGVQEVFETSYCLYPSHEKLLNDGFSMLLRACRESELRTVLSFLQAVLARIRSMHQQLCQELQRDNVDLFVQSSLSAKERHLAAVASALWRHFFSFLKSQRMSQVVPFSQLADAAADFTLLAMDMPSTAPSDFQPQPVISIIQLFGWDDIICPQVVARYLSHVLQNSSLCQVFAFSYISLSTVVIEGWPEKILQIYFNILLYQKYYCILTEKEYMEQLVKLTRLLFKLSEVKSIFSKAQVEYLSISEDPKKALVRFFEAVGITYGNLQILSDKSAMVTKSLEYLGEVLKYIKPYLGKKVFSAGLQLTYGMMGILVKSWAQIFATSKAQKLLFRIIDCLLLPHTVLQQEKELPAPMLSAIQKSLPLYLQGICIVCCQSQNPSAYLNQLLGNVIEQYIGRFLPASPYVSDLGQHPVLLALRNTATVPPISSLKKCVVQVIRKSYLEYKGSSPPPRLASILAFILQLFKETNTDIYEVELLLPGILKCLVLVSEPQVKRLATENLQYMVKACQVGSEEEPSAQLTSVFRQFIQDYGMRYYYQVYSILETVATLDQQVVIHLISTLTQSLKDSEQKWGLGRNIAQREAYSKLLSHLGQVGRDEMQRLENDNT

SEQ ID NO: 503 - protein, 1105 aa, Xenopus laevis
MFLVNAPPLASFQTKWAPFGQTTACRIPVSFSESEEDISRATISTQVQGIISTLQSDESSLEVTVEHEGIMQKTRKGDFNIERGLKTNAAVLKGHTRESATLVVPAEFRDNKDDHSEFGPLMLESDSDDSVDRDIEEAIQEYLKKKDTGEASNEGLNTTSSTSVEHGVLLNDAQNFAAANTCPVSMVTTSDICNSFRLKEQQRSSSPVSVSSDDSFEQSIKAEIEQFLNDKKQQKSKSKISSPPKVPCIETQSKPKLKTSKTSEKQNSKQAGSELLRKHASDSKLLRPSPETTKIQPKACVLKQNTKTSSPSPKSTPIVKEEPSDSSSDDGIEEAIQLYQLEKRRQGITPTVTPEKVKSPTSANSLTHFESRKRKSLNNKLAASQDISNCQPLLSKRPVLSEEDSFSKREIGAPTTCRAETAAELMCAEAILDISKTILPSQPQSTYVIPTEPPPPPPEPQCDSDSLVDSDDSIEQEIRTFLARKAQVEGAGISPVKLETTIETSPELGSQSSKLSLTHKRKAKAMQSDLMRKTLPLDKLGSNVELNQYPQPDERLQSSGKFAAKLSAPSEIHMGAGESIVIPEVSTALNRGRGRSHGLTRSYSSGDKSSSLDSDEDLDTAIKDLLKSKRKYKKRPKDGKSQCKKRVRFDETISKPVEISEDSKQPPKDPPFIKSCLLNSSTAKENSLEKSKKRREEKAVERNIPSCSSSPQGNKDGQPMPACASNEPNSKTRALDDAHESSSVDSDDGIEQEIRKFLAERAKVSSALTAAQNEAVSDSNIEKNTQTLKQEQAVLLNPVPETALQPEPCANISTAATAQASVVQLLALHSGKQSLLPVRLFNTRPVEVRTGMSPQSTPNCFIIKKECLVEQNSIIKPIEQCLPTAPGRVITQANLNSPQNFPVAGNFVAGLKYVSGTEKQLLLNVGHTGPSKLATEICKSMVHNSRLANCPPLDRKGPALERSKELPAISIIPKSPLVRSGLYLLTTKVCKENSPSLCLPINTTAYKTGINLMSIQYCQVNTQKPPCVGELSVNQPKSAESRVSVPGHATNPPLFVTRSREFKAAREGVEREGRTNLNKAASHDLVADSVKKVKEIKNSQESKNV

SEQ ID NO: 504 - protein, 674 aa, Xenopus laevis
MGALASRQHAGVEEMDMPCNSLYRYPPKSGSYFGSHFIMGGEKFESSHPEGYLFGENSDLNFLGSRPVTFPYTAPSPQEPVKTLRSLINIRKDTLRLVRCTEELKTTGVEGSRPKVHYNVEFTFDTDARVAITMYYQATEEFQGGIPSYLPKSSNLQSDTVHFKRGVSQQFCFPSHTVDPSEWREEELTFDLDREVYPMVVHAVVEEGEEHLGHSHVLMATFEKHADGSFCVKPLKQKQVVDGVSYLLQEIYGIENKYNSQDSKVAEDELSDNSAECVVCLSDVRDTLILPCRHLCLCNACADTLRYQASNCPICRLPFRALLQIRAMRKVPGPHSPGGFSPIIAAPTSDSEEHTSEHVPPGYEVVSLLEALNGPLTPSPSAPPLRALGEARRPGGLPSYGSDIHLRMHSPLQHLCGGQALKLKKSISRSISQNSSVLQEDEMEKSFSEAEIQTPRKKTSQLAEENGVTPESENLTLSSSGAIDQSSCTGTPLSPTISSPEDPLSSSLAQSIMSMASSHSQQSQLSTDTVSSMSGSYTAGGMEEEEGGITPSPPAAASGSPSIEGELSPAESPEPHFVTVSAEEMDAEGNVTEEEFASPEEDDGQMTGRECDNNNAAGVTLRDVLDNVRGSEGCLADVCYSSIPGQQRSNPYHGSDNCISLQDDTQSHLSTKLV

SEQ ID NO: 505 - protein, 1210 aa, Xenopus laevis
MEPTEANGYHSRLYKLHSIEENECESETEALKPPETAHWTERTTQAVPLDQIIPENMKESPSVQPIKNSKSIVSSAKKVISALGPSGQSLIADFVHINDCLKSSSEKCSEQTETVISDLCIHLVMVRNGVPDPHLQVELRNRLRLLENDNKEVVSVFSELSARLLSIESDKDVITVTFKTFEEIWKFSTYYTLGFLTHCLENMFLDQSFWLSSPEEEDAGLQVCVKEETVNLICRNLLMEEGMMFVLCADNLIRQAAVVDNALHVIHPDAPNHGLTIGWSHNENSTEESKTAEPLCPFHQWFLKTNSLSKLSDSVCLEQKNKIAVGWTEATVSYESAAPDEIAYCSGDIIEIIGTFVECLKWFIGRNMTTDRVGFVKTSDVKPYASEERKEHLAFPVSEENRMFGTRESDFTLENAKALLHKISHSDVCNVYRVELEAIREPQSQEITSPDINDEEDNWKEKMEAFLQNNKECCPSSEEANEPERGTADSSIEKNVLTCEDSDFPSFCISEELERNEGFQTLLLFLNSEKYLPGFRCIYDISYGFLHALFHGYKEEEELVRYLSMVRDSAKKASMPLALTRICFLLGRLCTKRLKFSQARVYFEEAIGVLNGDFRDIYLTSAIYMNLTAIYLKQKNNEKCSQVIDKAASLLIGLQSHISSTEMESLILKYALKTSILNQDLFSETRSCLLLGQMYTSRRQFDEALPFIERLQVLSNKMDSCDWCLPGYYFQLADIYSHKCLPHIALSSIKVASRGPCSFTDSLRKVDFIIGNAAKLCGIKGGRLSFPTQISYYLRQALDSAVTDQEQILSTSIYRSLWQLCTQHKEYKKAKLYILKALDPGICTDMKSRVDITISLAWLYMLDGKHTVALDILDTVKKLCHCSPVQLGIIYNLSAIAFKQRNRTKEAAEHYFQALQLSKETAILQNQAAALANFGTLFLHLRANNLAENFLVKSVAIYCRLPNLDNGDDFIHILLILGHYYIKGGHKEKGRLYYEWAFLVAMEINHLESQLQAVQSLCHFYSTVEINEAQCIIYNEYQLSLARKMSDKDLEGQVLETISHLYLSLGTERACRSALEYTKRSLGIFIDLQKKEKEAYAWLLSGKIYYILGQNELVDLYIQVAQNVALCTAEAELGMQLFEAAGDIFFNGTYDRDKAVSFYRDCALPLAVKTVNIKAELRLCNKLVELLTNINSYEDVLEPAKRALELSEIS

SEQ ID NO: 506 - protein, 577 aa, Xenopus tropicalis
MAELLPGYSPSFKKPSEILRLSRRRSRSEASKAGVSPFSPGDVTKRVPGLRPFSPGPNKGAGVKRRNPFANLENTVCSPVKRRAESVPECASPEPRALVAARPSCWELGSPSPQPPQFNSVEDVIWGDPLADPLVKTESPEKPATACETPKGSVTFPADWSLKTRLLFTSSQSFSWADHLKAQEEAQGLVMHCRATAVSLPHSIQEPKLSTELRCAFQQSLVHWVHPSFPWVQLFPRIGIDRKMVGKNSPWSHDESLQQVIMSEWALSFTSLYNLLKAKLCPYFYVCTYQFTVLFRAAGLAGSDVITAVMSPTTRGLREAMKNEGITFTQPLVEEDPSKKQKNSEANSQGDITPKKENGNTETDEVSDESDEDESFSWLEEMGVEDKIKKPDSISIKLRKEKNEVKLDHKPESVVLVKGTNTFTLLNFLINCKSIVAAAGPQAGLPPTLLSPVAFRGATMQTLKARSVNVKTQVRSGYKDQFSLEITGPIMPHSLHSLTMLLQSAQRGSFSAGFYSHDPTAVFNTPIHPQAAKEISADLQNCGLHPSTVEQLSQVNQLGKLSLRHLELSDYRYTWKS

SEQ ID NO: 507 - protein, 1336 aa, Xenopus laevis
MEPNEKIQDGLGSCVGLTTHQALSRLQEQLSVELSNHQRQRKILPWKNWRRSFLYHKNRSSCFHWPGAALMLLATLMLLFCFGSQPQGSQGSEVGNACALLMLLLLDLFLMRRLEILKQQEVERRLIKIINDIKDILRRGLVWGDALYPDLYMPSAPSWSLHWAYRDGRLVNLPVSLLVDGDVIALRPGQESFASVRGIKDDEHIVLEPGDLFPPFTPPPSPRAEGKRVPQDPQQHHLFRVSKTPVLDNVRSWLDQALSRPVTALDNERYTVQSVMLMHAVPSIVAAFLITNALRLIFSAPGIPPWPYALLQLQVNAVLPVLPLLFPVMWILVTALGEARALAQMSMNSPTSLIAKFSEDTLSSYTEVVSTQEMMRCVCSHFLQVLRGKSETLAYTSSLLHGLGSVTVLCCVDKQGVLSWPNPSPETVLFFSGRVDQTTDRHDDGTDQMSLRSYCQADLEEEPQEMVALLADTDAMQFVNEQETPEKQGDSKTSDPTRKGHSRTKHTSGSNVSFSQVTAGPGNSEMDDYVCDCHLEMLRLSQDQQNPQSIQFDESNWQLHLSSLKPLGLNVLLNLCNPAVTATLCRFSDHLRHIALQEMHCSVLPGHIPWGLCDFSRLIGFTPGAKDLFKLENHVALYHLPSDEAVKDNLLSKLSTSARRRPPLSHMISLFVKDVTTNTEQMLSHGSADIILEACTDFWDGTDIYPLSGSDRKRVLDFYQRACLSGYCSAFSYKPMHFSLSPQLHGKCIELLHAPGHNALSAPCDLVGSIALKPGGRHDSWSSDEGIGEVIEDFTQALSGQIFMGMVSSQYQARLDIVRLIDGLVNACIRFVYFSMEDELRSKVFAEKMGLETGWNCHISLTPNGDGPGSEVPPSSPSHAGSLRDDLHQASREDAEGLLLMEDEGHSDMISFQPTDSDVPSFLEDSNRAKLPRGIHQVRPHLQNIDNVPLLVPLFTDCTQETMCEMIQIMQEYREVTCSIGSSASIRNSGLFLESDISICLDPLYPSRCSWEMFGYVSGPLQTTASEELSPLQISAALNCLPCSISFRQEECVGIIRLIEQARHSTYGIRKCFLFLLQCQLTLVIVQFMACLLQLPPILSTTDILWLSCFCYPLLSVSLLGKPPDNSIMGVATGKNLRSIPKKTQHYFLLCFLLKFLPSCCCCLACFWFSLQRFCEISSHSNSTNCSGIATYSYSAVAPDWFGSLSGALLLAQKLSACLIVLHIVFISISHVHRSKPLWKGSPFSNWWWSATILVLVLAQGLQAGLDLQLWTNKDTPLTFHLWDIPLLTWLLGTLSLIAILVINELVKLHEIRVRVRYQKRQKLQFETKLGMNSPF

SEQ ID NO: 508 - protein, 559 aa, Bos taurus
MWINFVKLRLFCCLLAVLMVVVLVVNVTQVEYLDRETASATFIDSGGQFVSSQVIRISRNPYCGYERQILSSRERLEEDSLLAALQWQEPDVGPVPFLKSTDPSSSYFVILNSAAFFRVGSQLEVLVHVQDFQRKPKKYGGDYLQARIHSPKLQAGAVGRVVDYQNGFYKVFFTLLWPGQVKVSISLVHPSEGIRVLQYLQEKKPDRVYFKSLFRSGRISETTECNVCLPGSLPLCNFTDLYTGEPWFCFKPKKLPCSSRINHFKGGYLKGLLTATENAFFQSGVNIKMPINSSGPDWVTVIPRNIKETNSLELSQGLGTFPSGYYYKDQWRPRRFKMRQFNDPDNITECLQRKVVYLFGDSTIRQWFEYLTTFVPDLVEFNLGSPKNVGPFLAVDQKHNILLKYRCHGPPIRFTTVFSSDLRYVANELNGIVGGKNTVVAIAVWSHFSTFPLEVYIRRLRNIRRAVVQLLDRSPKTVVVIRTANVQELGPEISLFNSDWYNFQLDTILRKMFSGVGVYLVDAWEMTLAHYLPHKLHPDEVIVKNQVDMFLSFVCPLET

SEQ ID NO: 509 - protein, 1317 aa, Xenopus laevis
RLLGGFGSKPGQMEETSRAQLVAQAPDSSFRESSYSYSSKSPIGDSLGNSFSSGVRIKEEPMDDDYNKALAPPPFVDKIKDEPDNSAEYTQQPKSSEGELKISAVFSVSGSPLAPQLSTSLQPPITCPVASKSLPAVPAVPSTSVRVSCSGCKKILQKGQTAYQRKGSTQLFCSTLCLTGYTIPPARPTTTPRRTCSSCGKLIADPKDVITAQFDNPSSSKDFCSQTCLSAYEIKKKPTVTIHTNSISTKCSVCLKNAVIRHEVNYQNVVHKLCSDACFSKFRSANNLTMNCCENCGGYCYSGSGQCHLLNIDGQCKKFCSSSCVTTFKQKSAKITPCALCKTLRSSAEMIENTNSLGRTELYCSVNCLSAYRVQAVTASGVQVQCNSCKTLSIPQYHLAMSDGSIRNFCSYNCVVSFQNLFNKPTGMNPSVVPLSQGQVIMSVAAGAATQAGNSTPSLVSATSTSSSSTVSNSAAVGLQRLAAQAQSHTPQQGTFPRMAVKLRCQHCSRLFATKPELLDYKGKMYQFCGKTCCDEYKKINMVLAMCEYCKIDKIIKEAVRFAGIEKMFCSEGCKLLYKHDLAKKWGNHCKMCSYCYQTSPKLVRNHFGGKLEEFCGEECMSKFTVLFYQMGKCDGCKRQGKLSDCLKWRGEVKHFCNLLCILVFCNQQQSTTEPTPPNTTASVPMVQAVPASSGSSGGKDSTPVIANVVSLASAPAAQPTPNSTNVLQGAVPTVTAKIIGDASTQTDALKLPSSFPPRLLKNKALLCKPITQTKATSCKPHTQHKECQTEGDGQPQILVLPVPVPVFVPVPMHLYTQYAPVPLTIPLPIPVPMLIPTTLDNADKIIDAIEDLKEKVPSDPFEADILQMAEMIAEDEEKEKPLSHGDQGSTYSGDLESEAVSTPHSWEEELNHYTLRSNNVPEQDAELQQQSRVGTEQDVEADFPTEASDPQGKGSSFFSRTRTRRKHRDGFPQPKRRGRKKSIVAVEPRNLIQGSYPGCSPLGSTLKYMYGVNAWKNWVRWKNTQDDHEELKFGVRPIKLKEDLLSCTFSELSYGLCQFIQEVRRPNGEKYNADSILYLCLGVQQYLFENGRIDNIFTEPYSRFMVELTKLLKNWHPPILPNGFMFSRIEEEHLWECKQLGAYSPIILLNTLLFFTTKYFQLKTVSEHQQLSFAYVMRRTKTMKYNTKTTYLRFMPPCHKSDTEHEKPSVGKRKRVEDEDGQFVMEMAENTDNPLRCPVRLYEFYLSKCSESVKQRNDVFYLQPERSCVPNSPMWFSTMPIDPGTLDSMLTRILMVREVHEELAKAKEDSEAELSD

SEQ ID NO: 510 - protein, 571 aa, Xenopus tropicalis
MKAAYDCRATKRACSDRKVLILGTNWANPQSGTMEKITISIVNDKATGNKRNIEEEADESPPPKKLRSAVFLCSTPSSAPHCSRDVDVFDEFDDTILERSEDESDSPLHMTLVQIEELLEGDSDYAAEPPGWEEESDTVLQELAVPNADGSQRNIVEFRNLNSPLVEEQSDSSHTLTEETVCSQDTSNYAAMAPSPCWSSISTAEQNGEAGDNVLSVCPITSPVLHKNEVNRGSVQDCSEVCNDSDICSTLSSSHLPGDLKVVDEISEDSDIPFDGDIDELLTLSPGDTTSEDEDNKITSESTPASSELESVPLVHSHTEAIYKTPSSLQCPVTFTASTDPSNLSQLSVSSVTAINGQNNSNKVPLPPSDTAPGPQLPADPCSQSSKVLKVEPKENKVIKETGFEQGEKSCAAPLDHTVKENLGQTSKEQVVVSIGCKKKVKPSQLQQKKLGTLPTKPQAACRPQISNAELEKNRNIYRDRVMMHLEVHNIPGEPNYELATLLNETSRENPTWQHPSDYTRRNYYVRKQPVPCSLNDWVMRNGGPAIERFHGLPCTFQRSPMPGVLPTGPS

SEQ ID NO: 511 - protein, 778 aa, Gallus gallus
MPFWCYWHPCSCRTVRSPQTEPNAALCRSVPFPALAGWILLQPGFGLLKVLFPYLKEFRTEQCPLFLQHKCTQHRPFTCFHWHFLNQRRRRPIRRRDGTFNYSPDVYCTKYDETTGICPDGDDCPYLHRTTGDTERKYHLRYYKTGTCIHETDARGHCVKNGIHCAFAHGPHDLRPPVYDIRELQAQETLQNGQLGCGEGIPDLQPGNLASQAMIEKILSEDPRWQDTNFVLAGYKTEQCTKPPRLCRQGYACPHYHNSRDRRRNPRTFKYRSTPCPSVKHADEWGEPSRCESGDSCQYCHSRTEQQFHPEIYKSTKCNDMRQTGYCPRGPFCAFAHGEIKPGAHLFSTDSIGITNEWSSSVNATNSLTSNSGQSGNISCSSSPPVTSSSGSSSSLSPLGPLCRQRSLANGVLCSESSTSGVSSPTSSYPKAPGFEREDQAKQRSFSAENQQKKNEPDTKQNHLSVFSVVNPLASSITSSLASSVGSDSSSPTTVSIISTQTLPFYSAGNTVESVIGSALDIHFNGVNVASINRELEDQEGSDLGLASKRLLESSAPVNIPGSLVRSSSLHSSSSLSTSPLNSLSQSLSQSFVSSTMVPHQQQPQPLKSEQNILGTSASSHNSLGLNGVTGSMWDFVSGNFSPSPSPVLSSGTAPSVSSNSSGNELTRVRQELDDAKRKLKQWEESWQQVKQACDAWQKEAQEANERADVASADKQLALQKKEAVENKLKKLKVQLAACLSTSLPYMENYGDIEKISLPKLRSLQSRLHLDLGTIDEV

SEQ ID NO: 512 - protein, 431 aa, Xenopus tropicalis
MAGEVEGEGCRVSWGVLVALLLLPLPSLCSLTAGKQLQVIKLFEGRVVRYNESKNFCYQRTYEPKWSDVWTKIQIRVNSTKMIRVTQVENEEKLKEMETFNMFDFFSSFLKEKLNDSFIYVDLYNNKTCIKVHVSDTDTYYSVALSRGFDPRLFFVFLCGLLLFFYGDTLSRSQIFYYSTGITVGMLASMLILVFMLSKLMPKKSPFVALLLGGWSVSIYVIQLVFKNLQAICTEYWQYLLGYLGIVGFVSFAFCYKYGPLENERSINILNWTLQLIGLLLMYISVQIRHIAVTMVVIAFCTKQIEYPVRWIYILYRKIKLKRGKPSPPRLLTEEEYRKQGDVETRKALEELRGYCSSPDFAAWKTVSRIQSPKRFADFVEGSSHLTPNEVSVHEHEYGFGGSFLEDELFGEDSDVEEEMEIEPVLYQDLR

SEQ ID NO: 513 - protein, 686 aa, Macaca mulatta
MEVLIGDPITTCLSPSVYDIICNLGFQLRENCDINSIVTQNGEVCWKTITDCVSYTESDQGLDYWGSVRLLGPVCEAVHSHFLSLTKGQFEIRYAPWFQWTSFPELFPEIFDALESLQSPAISLSLMKLTSCLEQALGDVFLLIGKECPFLLRDLLASEELAQVFGQSVMNVLKVFVGSPCGLNLRNVLWHGFASPEEVPPKYCSMMMLLTAGLGQLLKSYLQKTKLTLAHRSFITPTNLEDLIVFPDVTYEVLSVLEEAMTKSAFILKIMLPYWEVALVKFKSHRFADCAILLLTQLETGLRNVFATLNRCPQRLLTAESTALYTTFDEILAKHLNDGKINQLPLFLGEPAMEFLWDFLNHQEGPRIRDHLSHGEINLHEFSKETTNQLLAFSVVLLLRFVDEGLLSVFKEKASVELLISLAEGYSSRCHPVFQLKKQVLSCEESIRVWALLPFPKELIWEAVRLEDNSETNACHSLITKMMDELYHHMPEDHCVLKDLDHLPTETWPQLLRELCSTPVRTLFCPRIVLEVLVVLRSIGKQCHRVSGQVTIASELRHRQWVERTLRSRQRQNYLRMWSSIRLLSPVLSLILFLITLELVNVHAVCGKNAHEYQQYLKFVKSILQYTENLVAYTSYEKNKWNETINLTHTVLLKIWTFSEKKQMLIHLAKKSTSKVLMKTYKSGCL

SEQ ID NO: 514 - protein, 229 aa, Rattus norvegicus
MPPECSACHTSAPPATRVLHLPPECSACHPSAPPATRVLRLPHECSACHPSAPPATGVLRLPPEYSTCHRSAPPATRVLHLPPKCSACHRVLRLPPECSTCHLSAPPATRVLCLPPEYSTCHRSAPPATRVLRLPPEYSTCHRSAPPATQVLHLLPECSACHTSAPPATRVLHLPPECSACHPSAPPATRVLHLPPECSACHPSTPPATGVLRLPPEYSTCHPSAPPAT

SEQ ID NO: 515 - protein, 798 aa, Homo sapiens
MYIHVDANRRLEGTSSIGPAGPARAEPHRAGKRLCGAPWRGRAAGGFCLALQLWLLLDAHQRGERPVGNGCPTGQPRSPALPGHRGSYGATLGLRALLHIRRSTRCKVNKKSCSDLQGNSSATRGLAADQLPAGAPRTQWQMETRSLPQGSDDSNTPVAEPERLTTVIPPSEEQTEITLGEVTEGEIGPFSSIKVPIVFTPVVPGDVQARFKVTFKNPQCPTELLLLSSCVHMQLHFRVVGVAIDVPVWVPKPSVDLKICMYDRLYQDSVLVHTRSKAALRLKFEVCKELRAHLELLPKTGYIQAQSSYSVQLKFLPRHSLPEDAGRYFDKETRVLEAPMTIWVADQNKPVGFTVHAIVTTSDLELSPSEVDFGYCTIYEAIRTEISLHNHSLLPQEFGFVRLPKFVDVQPNDGFGTILPLETLQFCVIFQPTKAEEHRFQLTCKSEINRCFKLSCRAVGVHPPLELSHYQIKFAATALYDTSVATVYVINSHLSMSSPTHSKPRIGSEDASPMGPTSFEFLLPPDSPITISPSVGTVWPGKSRKLWAWQGLRVTLRAAEGLSEEGHRCLVQVAFRPVLPEKLIRQEALPLLNKEMETKSFRKNMAPQRKDLHGLSFSVLRAQNRDKLFKVSVPHVLEMRKRELRPSSDEYQAARATLLRAFQAKFDTFVVPCVVASGDIKDRKGSEPLSFSPHNTLYLELWCPTVAPSVVVTSHKGKTIFNFGDVAVGHRSIKKISIQNVSPEDLALDFSLLNPNGPFVLLNHSSLLRAGGTQVLVLSFSPHESILPGPQALTPAAK

SEQ ID NO: 516 - protein, 970 aa, Yersinia pseudotuberculosis IP 32953
MSRTINLSSPAMPYLLGEPALVLSKLEGEEAFSTLYSYTITAKTPANPLIPWQAASNVDLKSLIGKEMTIEMELDGNGLGDVRSVGKGTREITGLVERARYIGRDANQAIFEITIKPWFYLANLTSDFKIYQNKNVVDIIEEVFSDYNFPFEKRLATTYPILDFQVQYGETDFNFLQRLMEEWGIYWFFEHQDHKQKLILVDHVGAHKRSFSTAYHAIEYLSDEPKAGEEYITQFQTQETLTSGTWVTNDYDFTKSRADILAMDSKPRKTSFNDLEIYHWPGDYDQPDIGEHLSRVRIEERGALGSRAVGSGQLRGIVCGANFELKGFPVDKANREYMIISSRLTVAEVDQLSGGEDAFSCESSFTVQPTTKIYRHPQVTPKPKTNGPQNAIIVGPPGEEIWTDEYGRVKVRFVWDRYGTNSESDSCWLRVSQAWAGNSFGGIYIPRIGQEVIVDCINGDPDRPMVMGSLYNNVTRPPWDLPANATQSGMVSRTVGGGLTNYNGVRFEDKSGLEQYWEQAERDMSRLTKNNETQIIGADSVLNVGANRSEVVGANYNQDVLGTSMLAIGAASMLQVGLARSVVVGGAHSLNVVLANATNVGGANMTNVGGFNGLAVGGAHQTAVGGAATLAAGGPIAIGAGGELILSGDIVKIVGKSKVIIQGGEVHINSDDCCGRKTGNGGGAFGAFASLAGLLPLAGAIALPLPLPLLPIVVPPVTSPPDPTVPPDPTLPPDPTLPPDPTLPPETTAPPETTAPPETTAPPETTAPPETTAPPETTAPPETTAPPETTAPPETTAPPETTAPPETTAPPETTAPPETTAPPETTAPPETTAPPETTAPPETTAPPETTAPPETTAPPETTAPPETTAPRRKQRHRQKQRHRQKQRHRQKQRHRQRQRHRRKQRHRQRQRHRQRQRHRRKQRHRRKQRHRRKPRHRQRQRHRQRQRHRRNRREHRQGRRRHRLDFIDKR

SEQ ID NO: 517 - protein, 264 aa, Homo sapiens
MRLPLPPAQVHSSLSAGEKPGFLAPRDLPKHTPLISKSQSLRSVRRSESWARPRPDEERPLRRPRPVQRTQSVPVRRPARRRQSAGPWPRPKGSLSMGPAPRARPWTRDSASLPRKPSVPWQRQMDQPQDRNQALGTHRPVNKLAELQCEVAALREEQKVLSRLVESLSTQIRALTEQQEQLRGQLQDLDSRLRAGSSEFDSEHNLTSNEGHSLKNLEHRLNEMERTQAQLRDAVQSLQLSPRTRGSWSQPQPLKAPCLNGDTT

SEQ ID NO: 518 - protein, 367 aa, Strongylocentrotus purpuratus
MNELKEEDTKGFRNFLRMDYDLYQEILRRIEGRITNPKASRYRKPLSPGIKLAMTLRYLASGDSYHSLMYGFRVAHNTISKVIRQVCAAIVAEFSEELIPCPTTPNEWKKIAEHFSNRWQLHNCLGALDGKHIAMKCPSGGGSMYYNYKGFHSIILMALVDGDYKFSWVEVGSNGSAGDAQVFNNSELKEAIEKGVIGIPPPEPLPHDDQPMPYFIAADDAFALRTWLMKPFSKRNMDNSERIFNYRLSRGRRIVENAFGILAHRFRCLLTTMQQDPNTVTSIVLSCICLHNLLRLRKRKEHTTVADQEDANHNIIPGEWRKDNPLLDGISDLGRNSTTNAAKKQREYFRAYYNSEVGSVPWQNDMI

SEQ ID NO: 519 - protein, 219 aa, Gallus gallus
MDLQGWLWIYKIFEWIYKDGYGFTRMAMDLQGWLWIYKDGYGFTRMAMDLQGWLWIYKDGYGFTRMAMDLQGWLWIYKDGYGFTRMAMDLQGWLWIYKDGYGFTRMAMDLQGWLWIYKDGYGFTRMAMDLQGWLWIYKDGYGFTRMAMDLQGWLWIYKDGYGFTRMAMDLQGWLWIYKDGYGFTRMAMDLQGWLWIYKDGYGFTRMAMDLQGWLWIYND

SEQ ID NO: 520 - protein, 416 aa, Xenopus tropicalis
  misc_feature (194)..(205): Xaa can be any naturally occurring amino acid
MYQRGGDRGWHQGHDNAYHHQRDVYPVRSHCSRPYRGGHPRHREHGNYGSEGYHEYPDNSCHERNYGDGQYMDYEEPPYHSEDRPYQEYRDSGYSRGGHHDSGYHKGSYYRGGYRGGDQGRYHSKHSETYRKKHSSKYSKVYSKDYETAGKSKFATTKPAPKVVPNPVRSVVVLVSGDEGERTVYQKKKLVQKXXXXXXXXXXXXQLSNQMFEYYNPFSSWCVCIAAIKTDCIFFFCPVFRKAYLLTAKRMTHLELRESTLVKENIALTTIKARERPAQRNCVVKGFQKCAAMKTRRSLCWMTGLLFPHPHQLQVLVIRVEPALKDRSHLKLLWHYALPLSPKRKSWRWHMLKTAEHLLLWQTHCKRTQQFRLPLVLFVLVCMTLVVVCMNPALKAMIEKTMSFSVLKKMYRTLMS

SEQ ID NO: 521 - protein, 1802 aa, Tribolium castaneum
MFARTQSTFVWIMATGLAFLGVLRALTIDNQLQVIKNDCYERLAIGQRHNPKDVYKTSQVTTVLECQLFCTKEKELCKSFSFGIGVKGNASCELSNDTIKETADLKPIGTKADTEFDLYIKKLGCTLVIDKNNPAFDQYSNNNKPQSTEYGQPQGGSYGTTPNKPSSGYDKPPPSPSYEKPTRPSSSGYDKPSSSGYDKPSTSGYDKPSSPNYNKPTYAVNEPPSSGYGYGSPNKPSYSKPQEETGHVETMVSISTGPQKPVLHPVHEILVGQGLYNYARPPFRPPALNHPYDRYDYDSRPGESNQVPYGHRPIPEKYGSYIPRPDNYYRPEPDDYYRPRPEHEYYRPRPNDDYGHRPGDYYRPNYRPRPPIDDYDRPTRPSSNYDRPRPPSGGYDRPDPPNNYDRPRPPTGGYDRPDPPSSNYDRPRPPIGGYDRPDPPSSNYDRPRPPIGGYDKPDPPITNYDRPRPPIGGYDRPEPPTGNYDRPRPPSSGYDRPNPPTSSYDRPKPPSGYDRPDPPTNNYDRPRPPSSNYDRPDPPNGNYERPKPPSSNYDRPNPSSTNNYDRPKPPSNTYDRPDPPTSNYDKPRPPSDSYVRPEPPSSNYDRPRPPSDSYVRPERPSSNYDRPNPPSSSYDRPSKPTNEYLFDKTIDRYDTQPEKGDNYQKPGTVKPTDGYDNSIKGNPKPKEPHSKPIVTHAIGSHGESITSIITELDEACFRRVLAGKRVTRALVKRALFCERVEDCQRECADEKRFPCEGFNYRLDPSGRGKGECELLEIPLSHLDIGRDLYPDPDYDYYERDRNAASANCKGGYYEQYGGNDGYYNRRHDQRPFDWWEEDRNRYGNRRPRPDFGYNRPDYGYDGYRPNGNRRGDFAYHHSHHSDPHNYHFEHYDHGLAPYDYKSYEPYLPPHRRPPYDEDRFYNKHYGNRDREKNYWGIAKPTWGTYGGSYGTSYNPHEFDRRNYYLPPQIGGSKDWGQYGGSYGNGGLNLQYNGYGHSQSFDFWGLNKYEEKFHNYGELPPNKPPSGGSYPPLKPPSNEGGNYLPVLPPKRPTSGSYLPENPPSYLPVLPPKSPNEGSYLPEKPSHGGSYLPEIPSKPPNGGSYLPELPGRYPINTGSYLPLPGKHDNDFYNSILPAEPRYPYRYDFLKDECSLRTAAGFRLQKGIVKKFYAVPNIYECELLCFKEKEFPCASYAFRYTVSLTSPTDNCYLSNRNYKELDYYTDLEPDRDFDVYTMNNMKKCDQPVIRGKEHSECFWRVRSAQRLDHKVVRDSLSVKSIVDCQLECLKSIGFTCRAFSYRYGSPVIGGPVDNCLLTDWPYYEMDPRIHFVPEPGFEIYERGSFGHGCEPTKIKKYILVCYSGYGSPSKLLPQACRKEIQVATEEECKAECSKYRDKTLFHCMSLSFSTRSSKWEPNCRLSDILQRDLLPNVDYIPDPDSWLFAWDNYNPECTATAHNPSHNHIGHKEDRNDFDDMSNAIGTWRVYSVSGWPCRRGSRCRENREAGFWFCELEGGDSNTWDYCCRPDHQCGFSHGFEYQWCFVGSWSDRWNSPIFVLVGWCYVGPSRTQWRKCSDRYYPYVHNLIDRFDRPPASAPWTPNNYLPDTRPPPYLPGGRPDRPPAPPTRPPPRPTLDEYEMQFESQFLDPPKPGGFGQPRHWPLSYLHKEMPPNSTDSDSRLMKAVQGRDSNPKFAAIQNLIDIIKSNDLKNVQYQITNESNKHDDILFVKIPLPTNFTQETRKSEKMVNATSVISGPIDLGNGGKNTTKRSQKALPVQERPVPVYRRGYITRTNVTNHRPRVSRTL

SEQ ID NO: 522 - protein, 328 aa, Danio rerio
MASHCVGESDGLTFYLARPEDYDDVMAISHDIYGGMDYLPHRYHSWITEPGRVVIIARRDEKLVALESGLVVDGGETVVVEGLRVSPHERGCGLAGVIQTFADGYVKKIHPRVKSKRLTRGDDPGPEKLRKFALLARRAVLSLWGKSEGFDGFVSSLKQKLLASGVSNSSFRPLVSVQDSGALQAVLLDPDLPSRLQLPGAALIQDWQPLRLVQSNLQILARRDLTWFIDGSGEKPMFLSLHTPLYPVPFDGGSLRFNIDLYGTDPSLAKTALTAHLDRVKSDLQGMVVVHIYMHQTLWKELQQFCEGHEMVRQFRDYWEQLFLERDI

SEQ ID NO: 523 - protein, 1181 aa, Macaca mulatta
MSSSANFLPSRHGTPELRKQYSGIESGQTLLMGDRTLVDHGQRNSAQRRVTVHGVFGLAQGHLVTRGRVPSWRQILRVDETRAAGNYFPEPGLVKQLSAASAVVAPAAAATEGSISDTSAGKMEDGAPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVLLVRTDKRSDSLIRVLEAGKANVILPKSSPSGITHVIASNARIKAEKEKDNFKAPFYPIQYLGDFLLEKEIQNDEDSQTNSVWTEHSNEEKNKDFRKDAGFLEMKGALKETMYRTQKEMQNHDEDVNVGSILSEHHKKEKFSGSSKDLKFVKMRNTFGSHTYENQKEIKKKDEDVQRSYTLRRKRKKEKESNCKKDVEHEKIKSTLRRHIYNRDQKEMKNSIFAEYAKESKAMAIKTDVDVVEIKNALRKHIYRAQAVRYNCVRIDKQPVYNVEVKNTEFPRGVLNLIESLIEGQFFKEAIEELSTLQAHYIPPVCILHALLENVLQDNIDTFSGRYFHILSALLHLHPPWKSPAMSRYYLELFQCPTCMKGAWSLVEVLIRSCLFNESFCHQISENIGSKVLHLTLLKFFFNLIESEVQYLSQKLYDWSDSQNLKITGKAMLLEIFWSGSETSGLLTKPVNMLLEWTIYSHKEKCKSNDVFKHELAYLLTGILGAAIDYWIFLGLKMGRNVMRHMSDDLGSYISLSCDDFSSQELEIFICSFSSSWLQMFVAEAVFKKLCLQSSGSVSSEPLSLQKMVYSYLPALGKTGVLGSGKIQISKKIGQRPCFDSQRALLMLNGTKQKQVEGLPELPDLNLAKCSSTLKKLKKKSEGELSCSKENCPSVVKKMNFHKTNLKGETALHRACINNQVEKLILLLSLPGIDINVKDNAGWTPLHEACNYGNTVCVQEILQRCPEVDLLTQVDGVTPLHDALSNGHVEIGKLLLQHGGPVLLQQRNAKGELPLDYVVSPQIKEELFAITKVEDTVENFHAQAEKHFHYQQLEFGSFLLSRMLLNFCSIFDLSSEFILASKGLTHLNELLMACKSHKETTSVHTDWLLDLYARNIKTLQKLPHILKELPENLKVCPGVHTEALMVTLEMMCRSVTEFS

SEQ ID NO: 524 - protein, 180 aa, Gallus gallus
MEEQAAGRAEEPCGPAEGGSGAERGWAGGGGGDWMATHPTFTAMMSLDISDSSQIYAAFLVYLDLLEGRSWHEVKHVGLAELQLVCLHAREREQGDLQVMVPIPADVLVSHERLREIMKKAALPHDDPDTPLSITLAIVETDSTIVYYKMTDGFVLPEPPDDTEDVDNKQWKRKRRKLSK

SEQ ID NO: 525 - protein, 446 aa, Xenopus tropicalis
MTRRAVSRKRRAAPGTGPGEQSDWDHSAHKRKRLPPEKKSLVFYLKSRELKPHNDSSYLRLLRGHAACTLPGILSEREFHLGTLNKVFASQWLNHRQVVCGTKCNTLFVVDVQTGQITKIPILKDREPLSGSHQSCGIHAIEINPSRTLLATGGDNPNSIAVYRLPTLDPVCVGDGGHNDWIFSIAWISDTMAVSGSRDGSMALWEMTEEILSKSDFQHGLSRVPVYAHISHKALKDIPKESSNPVNCKVRALAFNSKNKELGAVSLDGFFHLWKAELTLAKLLSTKLPYCRENVCLAYGLEWSLYAVGSQAHVSFLDPRQPPQCAKSVYCREQGSGIRSVSFYEHIVTVGTGQGALLFYDIRAQRFLEDSTGSCRNSKYKGDLLKLSTGKGWLNHNEMWMNYFSDIDCCPNAVYTHCYDSSGTKLFVAGGPLPTGLHGNYAGLWS

SEQ ID NO: 526 - protein, 465 aa, Xenopus tropicalis
MSAKSASGSAGLESLPEPQIAYDEGFRYVWLGLFAEKITPQGDPTMVPLCGECGAEAYLALHRPKGRCAQCGYQCWRGPLRDEVMSTGHGVIMALMAKLNAGKLATAQQRVAAECVSAQEAAIPALEEQPEEAAAPAPQVGECCAMDETVSGEPQGVTVQGESPGEVSAPISPASSLEKPALPIEGVPLQSNPQGESDCVKEVAEAAMLPYIEVRAEEISAPPSYSQVLREGSLAEARAPGSATSSTPGGEEDLREAEEDEYSPALFKLPDLFYAPRKIPKEEEKEFWDQRPAPEPTAKQAKRPAPEPTAKQAKRPAPEPTAKQAKRPAPEPTAKQAKRPAPEPTAKQAKRPAPEPMAKQAKRPAPEPTAKQAKRPAPEPTAKQAKRPAPEPTAKQAKGQNQANGHTSQRPKPMGKQAKRSKLEPMAKQAKGQTGDQGQKQNQKANQAKGQNLSQKAETRAKVQN

SEQ ID NO: 527 - protein, 771 aa, Xenopus tropicalis
MEVGSVQHTDPFPPAPPGLCSEMLGVAEESYRAGNFELAAEIYGSQLEEQPQRFLWLRKGDALALAGRVTDALDCYTRAAMLSQLRPEELGVLVGSIARNIREKELGLPCAQREPGTAHPQYSVSPYSAPPAEPTPISDIFSCPMCRLLLLDPVTLLCGHSVCKRCLRAQEPLQCSQCGDKLKGKAEWPGVSLMDSKVNVVLGNLLQKWLKEETKVRRLSVEGELLRESSNLMGAMEKYSAALELTPCDSWLAAERAELYLAMKNYNQAISDADTVCKKEPLSHKGHYVKARALSGLGRTEEALKEFLYCVALNPEWSLMKIEAQKIICEMLFPAFENVQASLGTPLRALTSHTRLKPSLTNSNTCTEDFSLPGCSKDSKFQITKSFVESDIFVMEEFKDEPVSCMLPHSKAEESLGNVLVSLPGASLKRKLNSSEDYQSATAKVRKTGAESKCEQSATKLVLRDIPVALVDACDFECSLCMRLFYEPVATPCGHTFCLKCLERCLDHNPHCPLCKEDLAQYLAYRAYKKTLLTEELITRYLPEELTERKKIYDEEMKELSNLHKDVPIFVCTMAFPTIPCPLHVFEPRYRLMIRRSMETGTKQFGMCIADDLKGFADYGCMLQVRDVKFFPDGRSVVDTIGLNRFKVLSHGQRDGYNTANIEYLEDKKMEGQEYEELLVLHNSVYDQALGWFTSLKDNMKSQILSHFGQMPSKESDPQNGENGPAWCWWMLAVLPLESKAQLTILAMTSLKDRLHAIKRILIFVTRKRAR

SEQ ID NO: 528 - protein, 433 aa, Xenopus tropicalis
MEESHFNSSYFWPAVPTVSGQQIDNSMFLNKVKEQLIQEKGCNLSSHYPTLLTVPTSMSLPAGISMDTDSKVELHGIQHSQASVTQNITVLPVPTTGLMTATGLVITSPSGSLVTTPSSSCQTFPITAPSTMIVSTLPGSQTLQVVSDLTKAKISELGATGTLKSGRGRKKKRLPEPTLPDLNDPYDLSNEDEDDHQKDGKTYRCRMCSITFFSKSEMQIHSKSHTEAKPHKCPHCSKSFANSSYLAQHVRIHSGAKPYTCTYCQKAFRQLSHLQQHTRIHTGDRPYKCVHPGCDKAFTQLSNLQSHRRQHNKDKPFKCHNCHRAYTDASALEVHLSTHTVKHAKVYTCSICSRAYTSETYLMKHMRKHNAPEPQQPPPTQVLTSQAHFTPVSQASDGPQCSFDMNPFKTDHHKDLCLTVATSTIQVEHLASS

SEQ ID NO: 529 - protein, 2035 aa, Homo sapiens
MDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSGLGAEEPLSSMTDDMGSPLSTGYHTRSGSEEAVTDPGEREAGASLYQGLMRTASELLLDRRLRIPELEEAELFAEGQGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 530 - protein, 810 aa, Homo sapiens
MVMAYLVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAESKGTGKERPGLIEFEECDTASAVEGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISRHSPVQMNRNLSNEELTKSKPSAPPNEKGTSDLLAWDPLFGPSLDSSSSSSLTSSSSARPTTPLSVGTIVQPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 531 - protein, 3487 aa, Homo sapiens
MRLISIAPGPRWQVQSHHPRSAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQDLTYSHQISSFLRGFDLSELERTNSTPPVAASYVWDLDPGCEAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLAGHCGTPEPIVNGHINGENYSYRGSVVYQCNAGFRLIGMSVRICQQDHHWSGKTPFCVLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 532 - protein, 463 aa, Mus musculus
ADTTIVVKSYRPAQLTWSQLPEVLESGVLDTLSTEERKRQEAIFEILTSEFSYLHSLSILVTEFLQSRELRATMTQTEHHHLFSNILDVMSASQKFFEALEQRHKAQVCVEDISDILEDHAQHHFHPYIAYCSNEVYQQRTLQKLSNSNAAFRDVLKEIEKRPACGGLPMISFLILPMQRVTRLPLLTDTLCLKTQGHPERYKAASQALKAISKLVKQCNEGAHKMERTEQIYTLNMQLDFGKVKSLPLISASRWLLKRGELFLLEESSIFRKIASRPTCYLFLFNDVLVVTKKKSEESYLVQDYAQLDHVQVRKLEPSEPLLPGGSSRSSSVPYPFQVNLLHNSEGRQEQILLSSDSASDRARWITALTYKERQWQGITNKGELPQVEVTKAYFAKQADEITLQQADIVLVLQEEDGWLHGERLRDGETGWFPESFAHSITSRVAVEGNVRRMERLRVETDV

SEQ ID NO: 533 - protein, 2724 aa, Canis familiaris
MADEEAEQERLSGGGGGCVAELQRLGERLQELERQLRESRVPAVEAATEYCQQLCQTLLEYAEKWKTSEDPLPLLEVYTVAIQSYVKARPYLTSECENVALVLERLALSCVELLLCLPVELPDKQWEQFQTLVQVAHEKLMENGSCELHFLATLAQETGVWKNPVLCTILSQEPLDKDKVNEFLAFEGPILLDMRIKHLIKTNQLSQATALAKLCSDHPEIGTKGSFKQTYLVCLCTSSPNEKLIEEISEVDCKDALEMICNLESEGDEKSALVLCTAFLSRQLQQGDMYCAWELTLFWSKLQQRVEPSIQVYLERCRQLSLLTKTVYHIFFLIKVINSETEGAGLATCIELCVKALRLESTENTEVKISICKTISCLLPDDLEVKRACQLSEFLIEPTVDAYYAVEMLYNQPDQKYDEENLPIPNSLRCELLLVLKTQWPFDPEFWDWKTLKRQCLALMGEEASIVSSIDELNDSEVYEKVVDYQEESKETSMNGLSGGIGANSGLLKDICDEKQKKREIKQLRERGFISARFRNWQAYMQYCVLCDKEFLGHRIVRHAQKHYKDGIYSCPICAKNFNSKETFVPHVTLHVKQSSKERLAAMKPLRRLGRPPKITTTNENQKTNAVAKQEQRPIKKNSLYSTDFIVFNDNDGSDDENDDKDKSYEPEVIPVQKPVPVNEFNCPVTFCKKGFKYFKNLIAHVKGHKDNEDAKRFLEMQSKKVICQYCRRHFVSVTHLNDHLQMHCGSKPYICIQMKCKAGFNSYAELLTHRKEHQVFRAKCMFPKCGRIFSEAYLLYDHEAQHYNTYTCKFTGCGKVYRSQSELEKHLDDHSTPEKVLPPEDQLNSSGDCVQPSKVNQDTEVSIEKERSVLPSENNIENTLPADKSDAWDKSKTESAVTKQDQISVSELRQADGPLSNGLENPVTTPLLQASEVAVSIKVSLNQGIEDNFGKQENSTVEGTGESLVTNLHTPVGDTCNDLCRPGFQERKEQDCFNEAQITQNSLVNSETLKIGDLTPQNLERQVNNLMTFSVQNQTGFQNSLPASKFECGGNVKTSSSLYNLPLKTLESITFVPPQPNPSSSLGTPSVPPKAPVQKFSCQVEGCTRTYNSSQSIGKHMKTAHPDQYAAFKMQRKSKKGQKSNNLNTPNNGKFVYFLPSQVSSSNSAFFTSQTKANGNPTCSNQLQHVSPSIFPAHLTSVSTPLLPSVESVINPNIPSQDKNEQGGGIICSQMENLSTTTLPAQMEDLTKTVLPLNIDSGSDPFLPLPAESSSMSLFPSPADSGANSVFSQLENNTNHFSSQIEGNTNSSFLKGGNGENAVFPSQVNVANDFNSTSAQQSAPEKVKKDRGRGPNGKERKPKHNKRAKWPAIIRDGKFICSRCYRAFTNPRSLGGHLSKRSYCKPLDGAEIAQELLQNNGQPSLLASMILSTNAVNLQQPQQSTFNPEACFKDPSFLQLLAAENRSSTFLPNTFPRTGVTSFSTNVSQEGSEIIKQALETAGIPSTFEGAEMLSHVPTGCVSDAAQVNATVMPNPAVPPLLQTVCHPNPLLTNQNRTPNSKTPSIEECSSLPVFPTNDLLLKTVENGLCSSSFPNSSGPSQTFTSNSSRVSVISGPQSTRSSHLNKKGNSASKRRKKVVPPLIAPNASQNLVTSDLTAMGLIAKSIEIPTSNLHSNVIPNCEPQGLVENLTQKLNNVDNQLFITDVKENFKTNLESHTVLAPLTLKTENGDSQMMALNSCTTSINSDLQISEDNVIQNFEKTLEIIKSAMNSQILEVKSGSHGVGETSQNAQINYNIQLPSVNTVQNNKLPDSSQFSSFIGVMPAKNNIPSSEVLHKEDQIQEILEGLQKLKLENDLSTPAPQCVLINTSVTLTPTPVKPNPNVTVVQPVSEIISNIQFSDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKTQSENLSSPRITQVKRQLTVTEENKREFQPTLDLGAIKENSLSNVAVIPEKQLPEKKSPEKTESSLQVITVTSEQCNTNSLTNIQTKGRKIRRHKKEKEEKKRKKPVSDSLEFPTRYSPYRPYRCVHQGCFAAFTIQQNLILHYQAVHKSDLPAFSAEVEEESEAGKESEEIETKQTVKEFRCQVSDCSRIFQAITGLIQHYMKLHEMTPEEIESMTASVDVGKFPCDQLECKSSFTTYLNYVVHLEADHGIGIRGSKTEEDGIYKCDCEGCDRIYATRSNLLRHIFNKHNDKHKAHLIRPRRLTPGQENMSSKANQEKTKSKYRGTKHRSGKEGIKMPKTKRKKKNNLENKTAKIVQIEENKPYSLKRGKHVYSIKARNDALSECTSRFVTQYPCMIKGCTSVVTSESNIIRHYKCHKLSKAFTSQHRNLLIVFKRCCNSQLKDTSEQESDKSDVKNSDACVSESNDNSRTATVPQKEIEKKEKDEMDELTELFITKLINEDNASVETQAHTSSNVSNDFQENNPCQSEKQKTSNLKRVNKEKNVSLNKKRKVEKAEPASTVELSSTHKEEETAVAIQTTEEHPASFDWSSFKPMGFEVSFLKFLEESAVKQKKNSDKDHPNSGNKKGSHSNSRKNIDKTAVTSGNHVCACKESETFVQFANPSQLQCSDNVKIVLDKTLKDCTELVLKQLQEMKPTVSLKKLEVHSNDPDVSVMKEISMGKATGRGQY

SEQ ID NO: 534 - protein, 2506 aa, Homo sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWVRDTSEPQKEPNFRNITHDYNATNGAEIELTLSEDEEDYYGSSTNLKDHQVSNTALLNTQTPIYGTEHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCQFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGSFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 535 - protein, 996 aa, Canis familiaris
MAVEVYSLLGVQFGHGKEKKADHIGQSIGKEGRKSTKEAENMEESSSVAMLVPDIGEQEAILTAETVISSSLEIDEQRKVKTDPLIHVIQKLSKIVEHEKSQKCLLIGKKRSRSSATTHSLEAQELCEIPAKVTQSPAAEIRRAEMSQIHFTPGSLTQNDGKAMSYQCSLCKFLSSSFSVLKDHIKQHGQQNEVILMCSECHLTSKSQEELEAHVVNDHENDANSHAQSKAQQCVSPSNALCQRPTERKNETTSDIAVTADSPKTQTAQNASVAEMGKRKWYAYEQYGMYRCLFCSYTCGQQRMLKTHAWKHAGEVDCSYPIFENENEPLGLLDSSVVAEPGGLDAVVIAIGDNELSIHNGPSVQVQICSSETLSSSSPLEQSAEGRVHLGQSVTLDPNEEEMLEVISDVEENLIADSLLSSAQKIISSSPNKKGHVNVIVERLPSAEETLSQKHFLMNTEIEEGKDLSPTESQIGCEGRDEVYHADKCTVDIGGLIIGWSSPEKKDSELINKGLAADENAPPGRRRTNSESLRLHSLAAEALVTMPIRAAELTRANLGHYGNINLLDPDTGQRQVDSTLAAYSKMMSPLKNSADGLTTFNQSNSPLVALPEGRQELSDGQVKTGISMSLLTVIEKLRERTDQNASDDDILKELQDNAQCQPNSDATLSGSNVVEYIPNADRPYRCRLCHYASGNKGYIKQHLRVHRQRQPYQCPICEHIADNSKDLENHMINHCKTRIYQCKRCEESFHYKSQLRNHEREQHSLPDTLSVTTSNESRIAVDTADGKCVQEGNKSSVQKQYRCDVCDYTSTTYVGVRNHRRIHNSDKPYRCSLCGYVCSHPPSLKSHMWKHASDQNYNYEQVNKAINDAISQSGRVLGRSPAKTLLNSSEERADPVTGSSENLISSSELISQAPGEVVGSNDNEKLNPTSNTSYSLEKNSSLAPPSMEYCVLLFCCCICGFESTSKENLLDHMKEHEGEIVNIILNKDHNTALNTN

SEQ ID NO: 536 - protein, 492 aa, Mus musculus
MYHGMNPSNGDGFLEQQLQQQQPQSPQRLLAVILWFQLALCFGPAQLTGGFDDLNVCADPGVPENGFRTPSGGVFFESSVTRFHCQDGFRLKGSTKRLCMKHFNGTLGWVPSDKPVCIQEDCRIPQIEDAEIRNKTYRHGEKLVIDCHEGFKIRYPDLYNLVSLCRDDGTWDNLPICQGCLRPLASSNGYVNISEFQTSFPVGTVIAYRCFPGFKLEGSENLECLHNLIWSSSPPRCLALEAQVCPLPPMVSHGDFICHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPTYDEAVNGSSSALGPGYPASVGQGCPLPVDDQSPPAYPGSGDTDTGPGESETCDSTSGSSEMLQSLYSPPMCQGGSRPAPDTPDTISSTAGEVASTSPGIDIADEIPLMEEDP

SEQ ID NO: 537 - protein, 418 aa, Xenopus tropicalis
RARSPQGSGFDDDDVFDENVVVLDNYNSDLHFKLDKDRTVGYPLTIEGFAYLWSGARATHGVNRGRVCFEMKVTEKISVGHLPSNEPDPHVVRVGWSLDSCSTQLGEEPFSYGYGGTGKKSSNSRFENYGETFAEHDVIGCYIDFESHGDIEMSFSKNGQPLGVAFRVHKETLGSQALFPHILVKNCTVEFNFGQRPEPFCSAIPGFTFIQHVQPYERVRGTEPPKNKAECEILMMVGLPGAGKTTWAVKHAAAHPEKKYVILGTNAIMEKMRVMGLRRQRNYAGRWDVLIQQATQCLNRLIQIAARRKRNYILDQTNVYGTAQKRKMRPFEGFQRKAIIICPTDADLQDRIVKRTDEEGKDVPDSAVLEMKANFALPEPGDFLDEVIYVELQKEDAEPLVRQYNEEGKRAGPPPEKR

SEQ ID NO: 538 - protein, 517 aa, Homo sapiens
MAAQLLEEKLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKREAQLRASLEVTQQQATQAEGQLLELRKQSSQIQNSACILASWVSGKFSSLLQALEIQHTTALRSIEVAKTQALAQARDEEQRLRVHLEAVARHGCRIRELLEQVDEQTFLQESQLLQPPGPLGPLTPLQWDEDQQLGDLKQLLSRLCGLLLEEGSHPGAPAKPVDLAPVEAPGPLAPVPSTVCPLRRKLWQNYRNLTFDPVSANRHFYLSRQDQQVKHCRQSRGPGGPGSFELWQVQCAQSFQAGHHYWEVRASDHSVTLGVSYPQLPRCRLGPHTDNIGRGPCSWGLCVQEDSLQAWHNGEAQRLPGVSGRLLGMDLDLASGCLTFYSLEPQTQPLYTFHALFNQPLTPVFWLLEGRTLTLCHQPGAVFPLGPQEEVLS

SEQ ID NO: 539 - protein, 860 aa, Homo sapiens
MLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINEDIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 540 - protein, 504 aa, Gallus gallus
MFRVAEPNPTRAPAARKSWHFSRTMEELVHDLVSALEESSEQARGGFADTGDHSRSVSCLLKRQARKRRGRKRRSFTTHHPWETGHCLSEGSDSSLEESSKDYRENHTNKKDHSDSDDQLLIAKRRPSSNLNNIRGKRPLWHEPDLAVDNLGNRTLRRRRKVKRMAIDLPSEVSNALTITQHQDSRDQEMDNDNKSYQHQEFSKSKVKKRKVAAVRQGPEILDEGVVIENEEMNQANKDKMEYEEQKGSDENMSDSESSSLSSSDAGLFTNDEGRQGDDEQSDWFHENESGGACGITGVIPWWEQDDSTELERELPDPVFESILTGTFPLMSHSGRRGFQSRFSHLHGMPARNTKKASGNQNAMITPGPGGSRKTIHLSQDSLHHDHWFSPGARKEHSQLLRDNRSDRGHKKNSSVKTASRQTSVHLGSLCMGDIKRRRKAAPLPGPTGFVGENTQPIPENNIGNRMLQSMGWTPGTGLGPDGKGIAEPIRAIQRPKGLGLGFS

SEQ ID NO: 541 - protein, 529 aa, Gallus gallus
MEPGLVGPGPYRATRLWNEIIELFRAGMPLRKHRCRFKSYERCFKASEAVDCLHELLGSNQNFGPEVTRSQTVKLLKKFLKNHVIEDIKGRWGKEDFQDDGHLYRFPPSSPLKPYPKKPSFGKEVIKFPDWDDPKAGTSQEHIPVKSIMMNSETWYKRHSIAIGEVPACKLVFRRELTQENIEEIWKSMTLARLQKVLGLDCLDEVIDTKLVNSKHIVQNAYNVNKQGIVTLEDKSKDLPHWILSAMKCLANWPICSDLKQPTYSGFERDVFKTIVDYFGQMKEPLLTFNFFDVFVSVLGLLQKHNEAIEALQISCLLLPPESRRKLQLLVRMMARISFNKDLPPLSESVRTRVLMVQAFSRCILCSKDEMDLDELLAAKLVSFLMDNYQEILSVPSSLKSSIEEHVVHVQRVQIKYAGADTDAAFPAPSFCHQISTDEFEYQRATGSQEPLAALLEEIATNKEISVKDKKKKLKQFQKSYPEVYRVRFPTPETEAVLFPEKSKQKPPLLMWALRKPFQPFHRTRSFRM

SEQ ID NO: 542 - protein, 1385 aa, Homo sapiens
MELSDSDRPVSFGSTSSSASSRDSHGSFGSRMTLVSNSHMGLFNQDKEVGAIKLELIPARPFSSSELQRDNPATGQQNADEGSERPPRAQWRVDSNGAPKTIADSATSPKLLYVDRVVQEILETERTYVQDLKSIVEDYLDCIRDQTKLPLGTEERSALFGNIQDIYHFNSELLQDLENCENDPVAIAECFVSKSEEFHIYTQYCTNYPRSVAVLTECMRNKILAKFFRERQETLKHSLPLGSYLLKPVQRILKYHLLLHEIENHLDKDTEGYDVVLDAIDTMQRVAWHINDMKRKHEHAVRLQEIQSLLTNWKGPDLTSYGELVLEGTFRIQRAKNERTLFLFDKLLLITKKRDDTFTYKAHILCGNLMLVEVIPKEPLSFSVFHYKNPKLQHTVQAKSQQDKRLWVLHLKRLILENHAAKIPAKAKQAILEMDAIHHPGFCYSPEGGTKALFGSKEGSAPYRLRRKSEPSSRSHKVLKTSETAQDIQKVSREEGSPQLSSARPSPAQRNSQPSSSTMISVLRAGGALRNIWTDHQIRQALFPSRRSPQENEDDEDDYQMFVPSFSSSDLNSTRLCEDSTSSRPCSWHMGQMESTETSSSGHRIVRRASSAGESNTCPPEIGTSDRTRELQNSPKTEGQEEMTPFGSSIELTIDDIDHVYDNISYEDLKLMVAKREEAESTPSKSARDSVRPKSTPELAFTKRQAGHSKGSLYAQTDGTLSGGEASSQSTHELQAVEENIYDTIGLPDPPSLGFKCSSLKRAKRSTFLGLEADFVCCDSLRPFVSQDSLQLSEDEAPYHQATPDHGYLSLLYDSPSGNLSMPHKPVSDKLSEEVDEIWNDLENYIKKNEDKARDRLLAAFPVSKDDVPDRLHAESTPELSRDVGRSVSTLSLPESQALLTPVKSRAGRASRANCPFEEDLISKEGSFMSLNRLSLASEMPLMDNPYDLANSGLSQTDPENPDLGMEATDKTKSRVFMMARQYSQKIKKANQLLKVKSLELEQPPASQHQKSMHKDLAAILEEKKQGGPAIGARIAEYSQLYDQIVFRESPLKIQKDGWASPQESSLLRSVSPSQVHHGSGDWLLHSTYSNGELADFCLPPEQDLRSRYPTFEINTKSTPRQLSAACSVPSLQTSDPLPGSVQRCSVVVSQPNKENWCQDHLYNSLGRKGISAKSQPYHRSQSSSSVLINKSMDSINYPSDVGKQQLLSLHRSSRCESHQDLLPDIADSHQQGTEKLSDLTLQDSQKVVVVNRNLPLNAQIATQNYFSNFKETDGDEDDYVEIKSEEDESELELSHNRRRKSDSKFVDADFSDNVCSGNTLHSLNSPRTPKKPVNSKLGLSPYLTPYNDSDKLNDYLWRGPSPNQQNIVQSLREKFQCLSSSSFA

SEQ ID NO: 543 - protein, 802 aa, Homo sapiens
ASPPVFLPVFPARPPPSSPAGPLPGGIIWSPAMDAPKAGYAFEYLIETLNDSSHKKFFDVSKLGTKYDVLPYSIRVLLEAAVRNCDGFLMKKEDVMNILDWKTKQSNVEVPFFPARVLLQDFTGIPAMVDFAAMREAVKTLGGDPEKVHPACPTDLTVDHSLQIDFSKCAIQNAPNPGGGDLQKAGKLSPLKVQPKKLPCRGQTTCRGSCDSGELGRNSGTFSSQIENTPILCPFHLQPVPEPETVLKNQEVEFGRNRERLQFFKWSSRVFKNVAVIPPGTGMAHQINLEYLSRVVFEEKDLLFPDSVVGTDSHITMVNGLGILGWGVGGIETEAVMLGLPVSLTLPEVVGCELTGSSNPFVTSIDVVLGITKHLRQVGVAGKFVEFFGSGVSQLSIVDRTTIANMCPEYGAILSFFPVDNVTLKHLEHTGFSKAKLESMETYLKAVKLFRNDQNSSGEPEYSQVIQINLNSIVPSVSGPKRPQDRVAVTDMKSDFQACLNEKVGFKGFQIAAEKQKDIVSIHYEGSEYKLSHGSVVIAAVISCTNNCNPSVMLAAGLLAKKAVEAGLRVKPYIRTSLSPGSGMVTHYLSSSGVLPYLSKLGFEIVGYGCSTCVGNTAPLSDAVLNAVKQGDLVTCGILSGNKNFEGRLCDCVRANYLASPPLVVAYAIAGTVNIDFQTEPLGTDPTGKNIYLHDIWPSREEVHRVEEEHVILSMFKALKDKIEMGNKRWNSLEAPDSVLFPWDLKSTYIRCPSFFDKLPKSQLHSRLLKMPMSYYIWETLSQQIIYHLQEVSLGIVLPLSI

SEQ ID NO: 544 - protein, 919 aa, Homo sapiens
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 545 - protein, 533 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKIPLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARKAILTTDDRIRKPLMTRVVERSSSMTSTMTIGKFMLALAFFAIIIAYF

SEQ ID NO: 546 - protein, 868 aa, Homo sapiens
MASFPETDFQICLLCKEMCGSPAPLSSNSSASSSSSQTSTSSGGGGGGPGAAARRLHVLPCLHAFCRPCLEAHRLPAAGGGAAGEPLKLRCPVCDQKVVLAEAAGMDALPSSAFLLSNLLDAVVATADEPPPKNGRAGAPAGAGGHSNHRHHAHHAHPRASASAPPLPQAPQPPAPSRSAPGGPAASPSALLLRRPHGCSSCDEGNAASSRCLDCQEHLCDNCVRAHQRVRLTKDHYIERGPPGPGAAAAAQQLGLGPPFPGPPFSILSVFPERLGFCQHHDDEVLHLYCDTCSVPICRECTMGRHGGHSFIYLQEALQDSRALTIQLLADAQQGRQAIQLSIEQAQTVAEQVEMKAKVVQSEVKAVTARHKKALEERECELLWKVEKIRQVKAKSLYLQVEKLRQNLNKLESTISAVQQVLEEGRALDILLARDRMLAQVQELKTVRSLLQPQEDDRVMFTPPDQALYLAIKSFGFVSSGAFAPLTKATGDGLKRALQGKVASFTVIGYDHDGEPRLSGGDLMSAVVLGPDGNLFGAEVSDQQNGTYVVSYRPQLEGEHLVSVTLCNQHIENSPFKVVVKSGRSYVGIGLPGLSFGSEGDSDGKLCRPWGVSVDKEGYIIVADRSNNRIQVFKPCGAFHHKFGTLGSRPGQFDRPAGVACDASRRIVVADKDNHRIQIFTFEGQFLLKFGEKGTKNGQFNYPWDVAVNSEGKILVSDTRNHRIQLFGPDGVFLNKYGFEGALWKHFDSPRGVAFNHEGHLVVTDFNNHRLLVIHPDCQSARFLGSEGTGNGQFLRPQGVAVDQEGRIIVADSRNHRVQMFESNGSFLCKFGAQGSGFGQMDRPSGIAITPDGMIVVVDFGNNRILVF

SEQ ID NO: 547 - protein, 842 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 548 - protein, 369 aa, Mus musculus
HCSSPQGPRAAPGRPGSGGSGGGGRARTPAPAGPGREARTGPRKVASASAAASTLSEPPRRTQESRTRTRAPGLPTLPMEKPAASTEPQGSRPALGRESVQVPDDQDFRSFRSECEAEVGWNLTYSKAGVSVWVQAVEMDRTLHKIKCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKACIKYPEWKQKHQPHFKPWLHPEQSPLPSLALSELSVQHADSLENIDESAVTESREERAGGAGGEGSDDDTSLT

SEQ ID NO: 549 - protein, 610 aa, Homo sapiens
MGDVVEKSLEGPLAPSTDEPSQKTGDLVEILNGEKVKFDDAGLSLILQNGLETLRMENALTDVILCVDIQEFSCHRVVLAAASNYFRAMFCNDLKEKYEKRIIIKGVDAETMHTLLDYTYTSKALITKQNVQRVLEAANLFQFLRMVDACASFLTEALNPENCVGILRLADTHSLDSLKKQVQSYIIQNFVQILNSEEFLDLPVDTLHHILKSDDLYVTEEAQVFETVMSWVRHKPSERLCLLPYVLENVRLPLLDPWYFVETVEADPLIRQCPEVFPLLQEARMYHLSGNEIISERTKPRMHEFQSEVFMIIGGCTKDERFVAEVTCLDPLRRSRLEVAKLPLTEHELESENKKWVEFACVTLKNEVYISGGKETQHDVWKYNSSINKWIQIEYLNIGRWRHKMVVLGGKVYVIGGFDGLQRINNVETYDPFHNCWSEAAPLLVHVSSFAATSHKKKLYVIGGGPNGKLATDKTQCYDPSTNKWSLKAAMPVEAKCINAVSFRDRIYVVGGAMRALYAYSPLEDSWCLVTQLSHERASCGIAPCNNRLYITGGRDEKNEVIATVLCWDPEAQKLTEECVLPRGVSHHGSVTIRKSYTHIRRIVPGAVSV

SEQ ID NO: 550 - protein, 942 aa, Homo sapiens
MKRRAGLGGSMRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGGIGRVVNGAFMVLKGHRSIVNQVRFNPHTYMICSSGVEKIIKIWSPYKQPGCTGDLDGRIEDDSRCLYTHEEYISLVLNSGSGLSHDYANQSVQEDPRMMAFFDSLVRREIEGWSSDSDSDLSESTILQLHAGVSERSGYTDSESSASLPRSPPPTVDESADNAFHLGPLRVTTTNTVASTPPTPTCEDAASRQQRLSALRRYQDKRLLALSNESDSEENVCEVELDTDLFPRPRSPSPEDESSSSSSSSSSEDEEELNERRASTWQRNAMRRRQKTTREDKPSAPIKPTNTYIGEDNYDYPQIKVDDLSSSPTSSPERSTSTLEIQPSRASPTSDIESVERKIYKAYKWLRYSYISYSNNKDGETSLVTGEADEGRAGTSHKDNPAPSSSKEACLNIAMAQRNQDLPPEGCSKDTFKEETPRTPSNGPGHEHSSHAWAEVPEGTSQDTGNSGSVEHPFETKKLNGKALSSRAEEPPSPPVPKASGSTLNSGSGNCPRTQSDDSEERSLETICANHNNGRLHPRPPHPHNNGQNLGELEVVAYSSPGHSDTDRDNSSLTGTLLHKDCCGSEMACETPNAGTREDPTDTPATDSSRAVHGHSGLKRQRIELEDTDSENSSSEKKLKT

SEQ ID NO: 551 - protein, 1576 aa, Homo sapiens
MAERGLEPSPAAVAALPPEVRAQLAELELELSEGDITQKGYEKKRSKLLSPYSPQTQETDSAVQKELRNQTPAPSAAQTSAPSKYHRTRSGGARDERYRSDIHTEAVQAALAKHKEQKMALPMPTKRRSTFVQSPADACTPPDTSSASEDEGSLRRQAALSAALQQSLQNAESWINRSIQGSSTSSSASSTLSHGEVKGTSGSLADVFANTRIENFSAPPDVTTTTSSSSSSSSIRPANIDLPPSGIVKGMHKGSNRSSLMDTADGVPVSSRVSTKIQQLLNTLKRPKRPPLKEFFVDDSEEIVEVPQPDPNQPKPEGRQMTPVKGEPLGVICNWPPALESALQRWGTTQAKCSCLTALDMTGKPVYTLTYGKLWSRSLKLAYTLLNKLGTKNEPVLKPGDRVALVYPNNDPVMFMVAFYGCLLAEVIPVPIEVPLTRKDAGGQQIGFLLGSCGIALALTSEVCLKGLPKTQNGEIVQFKGWPRLKWVVTDSKYLSKPPKDWQPHISPAGTEPAYIEYKTSKEGSVMGVTVSRLAMLSHCQALSQACNYSEGETIVNVLDFKKDAGLWHGMFANVMNKMHTISVPYSVMKTCPLSWVQRVHAHKAKVALVKCRDLHWAMMAHRDQRDVSLSSLRMLIVTDGANPWSVSSCDAFLSLFQSHGLKPEAICPCATSAEAMTVAIRRPGVPGAPLPGRAILSMNGLSYGVIRVNTEDKNSALTVQDVGHVMPGGMMCIVKPDGPPQLCKTDEIGEICVSSRTGGMMYFGLAGVTKNTFEVIPVNSAGSPVGDVPFIRSGLLGFVGPGSLVFVVGKMDGLLMVSGRRHNADDIVATGLAVESIKTVYRGRIAVFSVSVFYDERIVVVAEQRPDASEEDSFQWMSRVLQAIDSIHQVGVYCLALVPANTLPKTPLGGIHISQTKQLFLEGSLHPCNILMCPHTCVTNLPKPRQKQPGVGPASVMVGNLVAGKRIAQAAGRDLGQIEENDLVRKHQFLAEILQWRAQATPDHVLFMLLNAKGTTVCTASCLQLHKRAERIASVLGDKGHLNAGDNVVLLYPPGIELIAAFYGCLYAGCIPVTVRPPHAQNLTATLPTVRMIVDVSKAACILTSQTLMRLLRSREAAAAVDVKTWPTIIDTDDLPRKRLPQLYKPPTPEMLAYLDFSVSTTGMLTGVKMSHSAVNALCRAIKLQCELYSSRQIAICLDPYCGLGFALWCLCSVYSGHQSVLIPPMELENNLFLWLSTVNQYKIRDTFCSYSVMELCTKGLGNQVEVLKTRGINLSCVRTCVVVAEERPRVALQQSFSKLFKDIGLSPRAVSTTFGSRVNVAICLQGTSGPDPTTVYVDLKSLRHDRVRLVERGAPQSLLLSESGKILPGVKVVIVNPETKGPVGDSHLGEIWVNSPHTASGYYTIYDSETLQADHFNTRLSFGDAAQTLWARTGYLGFVRRTELTAATGERHDALYVVGALDETLELRGLRYHPIDIETSVSRIHRSIAECAVFTWTNLLVVVVELCGSEQEALDLVPLVTNVVLEEHYLIVGVVVVVDPGVIPINSRGEKQRMHLRDSFLADQLDPIYVAYNM

SEQ ID NO: 552 - protein, 461 aa, Rattus norvegicus
MNDQYHRAARDGYLELLKEATRKELNAPDEDGMTPTLWAAYHGNLESLRLIVSRGGDPDKCDIWGNTPLHLAASNGHLHCLSFLVSFGANIWCLDNDYHTPLDMAAMKGHMECVRYLDSIAAKQSSLNPKLVGKLKDKAFREAERRIRECAKMQRKHHERMERRYRRELAERSDTLSFSSLTSSTLSRRLQHMTLGSQLPYSQATLHGTAKGKAKIQKKLERRKQGVEGTFKVSEDGRKSVRSLSGLQLGNDVMFVRQGTYANPKEWGRAPLRDMFLSDEDSVSRATLAAEPAHSEVSTDSGHDSLFTRPGLGTMVFRRNYVSSGLHGLGREDGGLDGAGTPRGRLHSSPSLDDDSLGSANSLQDRSCGEELPWDELDLGLDEDLEPETSPLETFLASLHMEDFASLLRHEKIDLEALMLCSDLDLRSISVPLGPRKKILGAVRRRRQALERPLALEDTEL

SEQ ID NO: 553 - protein, 1259 aa, Homo sapiens
MDASEEPLPPVIYTMENKPIVTCAGDQNLFTSVYPTLSQQLPREPMEWRRSYGRAPKMIHLESNFVQFKEELLPKEGNKALLTFPFLHIYWTECCDTEVYKATVKDDLTKWQNVLKAHSSVDWLIVIVENDAKKKNKTNILPRTSIVDKIRNDFCNKQSDRCVVLSDPLKDSSRTQESWNAFLTKLRTLLLMSFTKNLGKFEDDMRTLREKRTEPGWSFCEYFMVQEELAFVFEMLQQFEDALVQYDELDALFSQYVVNFGAGDGANWLTFFCQPVKSWNGLILRKPIDMEKRESIQRREATLLDLRSYLFSRQCTLLLFLQRPWEVAQRALELLHNCVQELKLLEVSVPPGALDCWVFLSCLEVLQRIEGCCDRAQIDSNIAHTVGLWSYATEKLKSLGYLCGLVSEKGPNSEDLNRTVDLLAGLGAERPETANTAQSPYKKLKEALSSVEAFEKHYLDLSHATIEMYTSIGRIRSAKFVGKDLAEFYMRKKAPQKAEIYLQGALKNYLAEGWALPITHTRKQLAECQKHLGQIENYLQTSSLLASDHHLTEEERKHFCQEILDFASQPSDSPGHKIVLPMHSFAQLRDLHFDPSNAVVHVGGVLCVEITMYSQMPVPVHVEQIVVNVHFSIEKNSYRKTAEWLTKHKTSNGIINFPPETAPFPVSQNSLPALELYEMFERSPSDNSLNTTGIICRNVHMLLRRQESSSSLEMPSGVALEEGAHVLRCSHVTLEPGANQITFRTQAKEPGTYTLRQLCASVGSVWFVLPHIYPIVQYDVYSQEPQLHVEPLADSLLAGIPQRVKFTVTTGHYTIKNGDSLQLSNAEAMLILCQAESRAVVYSNTREQSSEAALRIQSSDKVTSISLPVAPAYHVIEFELEVLSLPSAPALGGESDMLGMAEPHRKHKDKQRTGRCMVTTDHKVSIDCPWSIYSTVIALTFSVPFRTTHSLLSSGTRKYVQVCVQNLSELDFQLSDSYLVDTGDSTDLQLVPLNTQSQQPIYSKQSVFFVWELKWTEEPPPSLHCRFSVGFSPASEEQLSISLKPYTYEFKVENFFTLYNVKAEIFPPSGMEYCRTGSLCSLEVLITRLSDLLEVDKDEALTESDEHFSTKLMYEVVDNSSNWAVCGKSCGVISMPVAARATHRVHMEVMPLFAGYLPLPDVRLFKYLPHHSAHSSQLDADSWIENDSLSVDKHGDDQPDSSSLKSRGSVHSACSSEHKGLPMPRLQALPAGQVFNSSSGTQVLVIPSQDDHVLEVSVT

SEQ ID NO: 554 - protein, 443 aa, Xenopus tropicalis
MPCTCGNWRRWIRPLVVLLYIVGLIVGVPICIWKLQKMEVGVHTKAWFIAGIFVLMTIPISLWGILQHLVHYTQPELQKPIIRILWMVPIYSVDSWIALKYPDIAIYVDTCRECYEAYVIYNFMIFLLNYLTNRCPNLALVLEAKDQQRHLPPLCCCPPWAMGDVLLFRCKLGVLQYTVVRPVTTVIALICQLTGVYGEGDFSVKNAWTYLVIINNVSQVFAMYCLVLFYKVLKEELNPIQPVGKFLCVKMVVFVSFWQAVFIAILVKAGVISNTWEWKKVQDVATGLQDFIICVEMFLAAVAHHFSFTYKPYVQEAEEGSCFDSFLAMWDISDIRADISEQVRNVGRTVLGRPRKMFFNDDLEQNEHTSLLSSSTQDPISAASSIPPSPSGHYQGFGQTITPQTTPTATTMPEELYSADSPEADLVADHSKVPDESCNHLDS

SEQ ID NO: 555 - protein, 908 aa, Canis familiaris
MGTPVEATIKIKSSMLWLCKPQNDLDKVERDPSNDWKKQEEFGVARVNFGKEEDEEESKSEAERDDVFFYNLDVYSISCAESSGRCCPAHIRHPDPGPGSRRGATPSPLRSRGLGPDEGARDRVTCLALLTPGRLVAGGPGPLPAPGGGWCGPEWGRGRGGGREARPGSRRAGCARLSPGKLRAAGVLGPAAASFPGPQGPMGLHGDGRGPAGGRAARVGPRRSGGLRGGLAVFAAVAAVFTLTLPPSVPGGDSGELITAAHELGVAHPPGYPLFTLVAKLAIILFPFGSVAYRVNLLCGFFGAVAASLLFFTVFRLSGSYAGGILAAGVFSFSRLTWQWSIAAEVFSLNNLFVGLLMALTVHFEEAATAKERSKIAKIGAFCCGLSLCNQHTIVLYVLCIIPWILFRLLKEKELSLGSLLKLSLYFCVGLLPYVYLPVSSYLNQARWTWGDQTTLLGFLTHFLREEYGTFSLAKSEIGSSMSKILLSQVTSMRTQLSFNIQALAIWANICLARKDRQTPSLVWLFTGMFCIYSLFFAWRANLDISKPLFMGVVERFWMQSNAVVAVLAGLGLAALVSESKRVLNTSGLQWLEWLSATLFIIYQIYSNFSICDQRTNYVIDKFAKNLLASMPRDAIILLRGDLPGNSLRYMHYCEGLRPDISLVDQEMMTYEWYLPKMAKHLPGVNFPGNRWNPVEGILPSGMVTFNLYHFLEINKQKKTFVCIGIHEGDPTWKKNYSLWPWGSCDKLVPSEIVFNPEEWIKLTRNIYNWTEEYGRFDASSWESVANEEMWQARMKTPFFIFNLAESVSVPSAVKAQLYTYAYNLYKEIVYLQKEHPVNWHKNYAIACERMLRLQEKGTDPEVLISETIRHFRLYTQKAPNDPQLPDILIALKHLRKELQSLRNMKNV

SEQ ID NO: 556 - protein, 843 aa, Homo sapiens
MWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGICTNFQKNNPVHTLTEVELLAFTSCLLSQPKFWAIQTSALILRTKLEKGSTRRVERAMRQTQALADQFEDKTTSVLERLKIFYCCQVPPHWAIQRQLASLLFELGCTSSALQIFEKLEMWEDVVICYERAGQHGKAEEILRQELEKKETPSLYCLLGDVLGDHSCYDKAWELSRYRSARAQRSKALLHLRNKEFQECVECFERSVKINPMQLGVWFSLGCAYLALEDYQGSAKAFQRCVTLEPDNAEAWNNLSTSYIRLKQKVKAFRTLQEALKCNYEHWQIWENYILTSTDVGEFSEAIKAYHRLLDLRDKYKDVQVLKILVRAVIDGMTDRSGDVATGLKGKLQELFGRVTSRVTNDGEIWRLYAHVYGNGQSEKPDENEKAFQCLSKAYKCDTQSNCWEKDITSFKEVVQRALGLAHVAIKCSKNKSSSQEAVQMLSSVRLNLRGLLSKAKQLFTDVATGEMSRELADDITAMDTLVTELQDLSNQFRNQY

SEQ ID NO: 557 - protein, 500 aa, Homo sapiens [sequence omitted]

SEQ ID NO: 558 - protein, 353 aa, Bos taurus
MAMTLLEDWCRGMDVNSQRALLVWGIPVNCDEAEIEETLQAAMPQVHYRVLGRMFWREENAKAALLELTGTVDYAAIPREMPGKGGVWKVVFKPPTSDAEFLERLHLFLAREGWTVQDVARVLRFENSSPAPGPDMPAEMLNYILDNVIKPLIESIWYKKLTLFSGRDIPGPGEETFEPWLEHANEVIEEWQVSDIEKRRRLMESLRGPAADVIRILKTNNPDITTAECLKALEQVFGSVESSRDVQVRFLNTYQNPGEKLSAYVIRLEPLLQKVVEKGAIDKENVNQARLEQVIAGANHSGAIRRQLWLTGAAEGPAPNLFQLLVQIREEEAKEEEAAAEAALLQLGLEGHF

SEQ ID NO: 559 - protein, 221 aa, Xenopus tropicalis
LLLAAVSASIFVNMGVYSALPLAFSIALLIACGLTPSLGHSPRTPDRVSEADIQRLLHGVMEELGIARPRVEYPAHQAMNLVGPQSIEGGAHEGLQHLGPYGNIPNIVAELTGDNIPKDFREDQGYPNPPNPCPVGKTGDGCLANTPDTAQFSREYQLHQNLYDPEHNYPGASTWNKKLLYEKIKGASQRQKRTVNPYLQGQKLDNVVAKKSVPHFSGEEE

SEQ ID NO: 560 - protein, 1292 aa, Xenopus tropicalis
DDDEDAGEKFDFDSGDEIPEADRQPLEVPGDTLIDQGFQFPDPPVLPNEITKQELPTETSTKMATKKVNPYSIIDIAPFQEVDSATSEDLVSTDESTSPRVPSGYSVPVPCGYAVPSNLPLLQPAYSTPVIIRNISIDEQGKHWLSSSKRKNSLFKSNTAGNDIASTREEDVLAKWVANPANTEWMENPDEVIYDDVPRENSDSATDPEEMIYDDVENGEDGGNSSLDYGWSSSEFESYEEHSDSESKHGVPNSFLRGNNKRHLSQDLTRLKQHYEKKMKDLVANRVGAVEIQHFKHKHELKMQRLVKAAKEGTKDGLEKTKAAVKKGRSYIRTKSFVLHDRKSTSLEDDELNLFIDVDCMHIEAIMSPMPEGLSQQQVVRRYILGSIVESEKNYVDSLKRILEQYEKPLWETEPRLLSERKLKIVFYRIKEILQCHSLFQIALASRVAEWDTAEMIGDVFVASFSKSMVLDAYSEYVNNFSTAVGVLRKACATKPSFLEFLKQCQESSPDRITLYGLMMKPIQRFPQFILLLQDMLKNTNKGHPDRLPLQMALTELETLADKLNERKRDADQRCEIKQIAKAMNERYLNKLLSNGSRYLVRSDDMVETVFNERGEIIKTKQRRLFMLNDVLMCATANARSSVEGSSAVTTNQKYLLKWSVPLSHAEVIEYGESEDQGDQTLYSSLHVAEKVVVSSKPNKLYMGPGQLYNDLQNLLHDLDVVNQISQLVGQLKGNYQNLNHAVAQDWSVGLQKLILKKENEIRAADRCRIQLQLPGKQDKSGRPTYFTAVFNTFSPAAKQSWLSNLQMAKLALGEENNTGWFCLEDEGHQVKKEKHPLLVKHLPVVMSKQQEFKIECAVYNPEPYLSSENDPDTLSMHHGFLWIGSCTNQMGQISVLSLHNRSPKVLECFNVESRILCMVYIPEEAKQKQLSDAPDLENGSSRVPDVPTICLGMEEGSICVYKSSQGSKKVRLQHFFTPEKSTVMSLASISQCLYAGLVNGNLATYTKAEDGNWNTDQPKLIKLGVLPVRSLLIMERTIWAASGEQIFIIGQDSNAIEHQFEAHSEEGMVISHMAVAGVGIWIAFTTGSTLRLFHTETFEHLQDINIATPIHNMLPGQHRVSVTSLLVCHGLLMVGTNLGVIVSLPVPRLQGIPKVTGKGMVSYHAHHSPVKFLVKATAINKKYRRTPSRCSQISHSELKNEDSHCTGVQQNDEAAASATNNNNDSAVWLGGSMGSIAQKSDLSSSSGSLTLSHGSNSCDAGKEDCTLSDLLGDPSMPLPNSKQQKAKRLKA

SEQ ID NO: 561 - protein, 222 aa, Xenopus tropicalis
IRLQSRARPFLPFQHTCAGSLIHSEWLLLPAHCIDESQKLDSWRVCLGHAPEKCFSTDAIIKHENFAFPQNNDHSYDIALMHISEKVTEVQPACLPASTKFLPAGELCYWAGWAASSKGGAKFANTKEKFQVPIPILSYETCSQPKFWWSQLTTSMICAGFESAEKLKSECRNEAEGALFCKSSADAAWEIHGIASFGPSDCVVDKKPPVFTRVSAYKDWIE

SEQ ID NO: 562 - protein, 593 aa, Xenopus tropicalis
MDLKWFLLVTLLVHGLATINAHGGHHHDHDHDHDHDHDHDEDDGLDIDDELEDPEELKPETSTPPPAPKVTYKAPVPTGEVYFSESFDKGTLDGWILSKAKKDDTDEEIAKYDGKWEVLEMKDTKLPGDLGLVLMSRAKHHAIASKMKKPFVFDKKSLIVQYEVNFQNGIECGGAYVKLLSKTPEQKPEQFHDKTPYTIMFGPDKCGEDYKLHFIFRHKNPKTGEYEEKHAKRPDADLKSYFTDKKTHLYTLVLNPDNSFEILVDQTVVNRGNLLNDVNPPVNPPNEIEDPEDKKPEDWDERPKIPDPDAVKPDDWDEDAPAKIPDENAVKPEGWLDDEPEYIPDPDAEKPEDWDEDMDGEWEAPQVANPKCESAPGCGVWQRPTIDNPSYKGKWKPPMIDNPNYQGIWKPRKIPNPDFFEDLEPFRMTPFYAVGLELWSMTSDIFFDNFIVTSEKNVADDWANDGWGLKKAADGASAVDLRFGVPNYGKTPYPEYPWSRAFWITGIIHVLLCILLTFVFSLKQPLDAEHKKTDAPQPDVKEEEEEDEEEEGKANKIEEEEDAEESEPKQDEAEDQESQEEEEAEEEIKTKVR

SEQ ID NO: 563 - protein, 436 aa, Xenopus tropicalis
MITGTITSLHVTDVRFPTSLDQHGSDAMHTDPDYSAAYIVIETDAADGLKGHGLTFTLGKGTEIVVCAVRALSRHVIGKALGDIVNNFRDFYRQLTSDGQLRWIGPEKGAVQLATAAVLNAVWDLWAKKEKKPLWKLLVDMDPHQLVSCIDFRYITDALTEEEALEILQNGKQGQRDREEHMLRSGYPAYTTSCAWLGYSDEQLKKLCSDALKEGWTRFKVKVGADLKDDIRRCELIRGMIGPDNIMMLDANQRWDVQEAISWVKDLAKYKPLWIEEPTSPDDILGHATISKALSPLNIGVATGEQCHNRVMFKQFLQANALQYLQIDSCRLGSVNENLSVLLMSKKFNVPVCPHAGGVGLCELVQHLILFDYISVSGSLDNRMCEYVDHLHEHFMYPVIISRAAYMPPKDPGYSTEMKDESVLQYQFPDGEIWQK

SEQ ID NO: 564 - protein, 365 aa, Xenopus tropicalis
MQNNEILKPAKYFSELEKSVLLALVEKYKYVLECKKSDARTIALKQRTWQALAHEYNSQPSVSLRDFKQLKKCWENIKARTKKIMAHERREKGKLFGPESNSHQALKEKVASMIPEQLYFVQNQPDDERGYNHDTSNQEMDCKRVSLLDLEVLIDEQGKIQTKPFRKVPETNSLCDDGSPPQSIDKAFPNGDLELLIDEQGKIQAEPIRKVPVTDSQCAQGSPSSSIKTESFVVPERDVYEDQNSIVNMHSSESSLHSTPLFPSSKISANRTYGRKPSQNGIFTKMHEEQHHQQMSILQLQLIQMNEVHVAKVQQIERECEMAEEEHRIKMEILNKKKMYWERKLQTITKEWPVASFNRPFPNSP

SEQ ID NO: 565 - protein, 747 aa, Homo sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 566 - protein, 827 aa, Homo sapiens
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVAKVEQVKFDATSMHVKPQVAAQQKMVDDGSGEVQVWRIENLELVPVDSKWLGHFYGGDCYLLLYTYLIGEKQHYLLYVWQGSQASQDEITASAYQAVILDQKYNGEPVQIRVPMGKEPPHLMSIFKGRMVVYQGGTSRTNNLETGPSTRLFQVQGTGANNTKAFEVPARANFLNSNDVFVLKTQSCCYLWCGKGCSGDEREMAKMVADTISRTEKQVVVEGQEPANFWMALGGKAPYANTKRLQEENLVITPRLFECSNKTGRFLATEIPDFNQDDLEEDDVFLLDVWDQVFFWIGKHANEEEKKAAATTAQEYLKTHPSGRDPETPIIVVKQGHEPPTFTGWFLAWDPFKWSNTKSYEDLKAESGNLRDWSQITAEVTSPKVDVFNANSNLSSGPLPIFPLEQLVNKPVEELPEGVDPSRKEEHLSIEDFTQAFGMTPAAFSALPRWKQQNLKKEKGLF

SEQ ID NO: 567 - protein, 300 aa, Homo sapiens
MANCEFSPVSGDKPCCRLSRRAQLCLGVSILVLILVVVLAVVVPRWRQTWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 568 - protein, 378 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYGLGSYSPAPPGCGPHFVYSLMVRLSSDVA

SEQ ID NO: 569 - protein, 940 aa, Homo sapiens
MNRIRKFFRGSGRVLAFIFVASVIWLLFDMAALRLSFSEINTRVIKEDIVRRERIGFRVQPDQGKIFYSSIKEMKPPLRGHGKGAWGKENVRKTEESVLKVEVDLDQTQRERKMQNALGRGKVVPLWHPAHLQTLPVTPNKQKTDGRGTKPEASSHQGTPKQTTAQGAPKTSFIAAKGTQVVKISVHMGRVSLKQEPRKSHSPSSDTSKLAAERDLNVTISLSTDRPKQRSQAVANERAHPASTAVPKSGEAMALNKTKTQSKEVNANKHKANTSLPFPKFTVNSNRLRKQSINETPLGSLSKDDGARGAHGKKLNFSESHLVIITKEEEQKADPKEVSNSKTKTIFPKVLGKSQSKHISRNRSEMSSSSLAPHRVPLSQTNHALTGGLEPAKINITAKAPSTEYNQSHIKALLPEDSGTHQVLRIDVTLSPRDPKAPGQFGRPVVVPHGKEKEAERRWKEGNFNVYLSDLIPVDRAIEDTRPAGCAEQLVHNNLPTTSVIMCFVDEVWSTLLRSVHSVINRSPPHLIKEILLVDDFSTKDYLKDNLDKYMSQFPKVRILRLKERHGLIRARLAGAQNATGDVLTFLDSHVECNVGWLEPLLERVYLSRKKVACPVIEVINDKDMSYMTVDNFQRGIFVWPMNFGWRTIPPDVIAKNRIKETDTIRCPVMAGGLFSIDKSYFFELGTYDPGLDVWGGENMELSFKVWMCGGEIEIIPCSRVGHIFRNDNPYSFPKDRMKTVERNLVRVAEVWLDEYKELFYGHGDHLIDQGLDVGNLTQQRELRKKLKCKSFKWYLENVFPDLRAPIVRASGVLINVALGKCISIENTTVILEDCDGSKELQQFNYTWLRLIKCGEWCIAPIPDKGAVRLHPCDNRNKGLKWLHKSTSVFHPELVNHIVFENNQQLLCLEGNFSQKILKVAACDPVKPYQKWKFEKYYEA

SEQ ID NO: 570 - protein, 623 aa, Homo sapiens
MAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNMEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKKKKKKKKKKK

SEQ ID NO: 571 - protein, 224 aa, Homo sapiens
MPGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 572 - protein, 915 aa, Homo sapiens [sequence omitted]

SEQ ID NO: 573 - protein, 1004 aa, Xenopus tropicalis
MPILCGEINQVPVTKTRVDFSDFSRLQPPSTSESRYGGGGHNELDEEASTSGGASAPSPQSEAVTNDLQELSLQPGANVQVPFSRPCPNSPPLSERKNVLQLKLQQRRTREELVNQGIMPPLKSPAAFHEQRRSLERARTEDYLKRKIRSRPERAELVRMHILEETSAEPSLQAKQMKLKRARLADDLNEKISQRPGPMELVVKNILPVETSLKEAIIADVDYPKVVDNSSFDEDSSDALSPEQPASQESQGSIPSPLEMRPSETTPIPLLSPCQAFPCVQLGTDPFNQDSLQSTTITISNGLTASICKSLPALVKQSQPKPSIEKSQRTKKPKEPKPKVKKLKYHQYIPPDQKQKGTPAMDSSYAKLLQQQQLFLQLQIINQQQHQHYNYQTILPAPPKPLPDQQNTNGSSSTTVRSMPTVGPSTLATPTITRQNSNVAVGGRTGPLPHNLDEMKVAELKQELKHRGLPVSGTKIDLIERLKASQDPNTVTVPPVAKPTPVQPAKPPEVMPTLSISCLNTTESTKLCSTSSTPPGSPCPSEVSVVSMDEVSIISDALGETIACPVTQQVLQNSSAPVTEKSSSDPRDKDLMLREKDKQIEELTRRLKQKQELVERLRQQLEQEKRTQQHHSADDQQALILAVKQEPVSLTIDSINNKKETSEASNNVKKELNRVIACQQETQLLIGSMSGGIEGKVDGSGGTKLVFTLASPSSQLPEENRQIVLQNQKPALQLMPGTVLSLSPSNLQPILNMNGFQKRPADTSNSSIQKQKPVHNESPATPPPQPEPEPPPHSIFLTASSPPWSKDPPGYEEAVKQQPSSSEDGRPGGLQAEEFFDLLIQNLDLPSEFKDYLVPCLKQTSPSHPAVQTVPQVEMPPPPSPIQSALGRLEDFLESSTGSPLLRGNQDGPAFMPLIDDLHSQMLSSLAILDHPPSPMDTSDLHFSPVGDSLGLDISEPPLDGMDWLELSEPPAMNLTPLSTATPSVFSTDFLDSHDLQLHWDSCL

SEQ ID NO: 574 - protein, 464 aa, Xenopus tropicalis
MLFCAAAVLLIVLRCFDIGHATVRKPVESTGKKQYQVQHGACSYTFLLPEIESCRSASSNSYVSNSVQRDAPLDYDDSIQRLQVLENIMENNTQWLIKLESYIQDNMKKEIVEIQQHAVHNQTAAMIEIGTSLLNQTVEQSKKLTHVETQVFNQTTRLELQLLENSLSTNKLERQISDQTSEITKLQDKNSFLEKKVLGMEDKHTAQLQTIKEEKDKLQDLVLKQNTIIEDLEKQLVTASANNSFLQKQQHDLMETVHNLLTRMAPQNAPRSSFVAKEEQLAFKDCAEAYKSGFTANGIYTLTILNTTDQAKGFGDPAGEYWLGNELVSQLTNLQKYVLKIQLRDWEGNQAFSLYEQFYLGNEAQKYRINLKGYTGTAGKINSISQPGNDFSTKDADNDKCICKCSQMATGGWWFDACGPSNLNGMYYSMGQNTNKFNGIKWYYWKGSGYSLKATTMMIRPVDF

SEQ ID NO: 575 - protein, 821 aa, Canis familiaris
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLGIQVDDFLPKINGSTEKEKLIVEGHLTKVVEETKLSKENQARAKESDLSDTLSPSKEKSSDDTTDAQMDEQDLNEPLAKVSLLKDDLQGAQSEIEAKQEIQHLRKELIEAQELARASKQKCFELQALLEEERKAYRNQVEESSKQIQVLQAQLQRLHINIENLREEKDSEITSTRDELLSARDEILLLHQAAEKAASERDTDIASLQEELKKVRGELERWRKAASEYEKEITSLQNSFQLRCQQCEDQQREEATRLQSELEKLRKEWNVLETECHSLKKENVLLSSELQRQEKELHNSQKQSLELTSDLSILQMTRKELENQVGSLKEQHLRDSADLKTLLSKAENQAKDVQKEYEKTQTVLSELKLKFEMTEQEKQSITDELKQCKDNLKLLREKGNNPSILQPVPAVFIGLFLAFLFWCFGPLW

SEQ ID NO: 576 - protein, 207 aa, Mus musculus
MAEDKEAKHGGHKNGRRGGISGGSFFTWFMVIALLGVWTSVAVVWFDLVDYEEVLGKLGVYDADGDGDFDVDDAKVLLEGPGGLAKRKTKAKAKEPIKEELKKERGKAVPSKNEERRQGKKEQEDRGKGRKKPDSDTSQKASAAGKRDRDKEKASSDKSSKSKESWKKAVETKAVSSKVAARDKDRRGRSSSGHAHVSKENGQKRKN

SEQ ID NO: 577 - protein, 1099 aa, Homo sapiens
MSSQTKFKKDKEIIAEYEAQIKEIRTQLVEQFKCLEQQSESRLQLLQDLQEFFRRKAEIELEYSRSLEKLAERFSSKIRSSREHQFKKDQYLLSPVNCWYLVLHQTRRESRDHATLNDIFMNNVIVRLSQISEDVIRLFKKSKEIGLQMHEELLKVTNELYTVMKTYHMYHAESISAESKLKEAEKQEEKQFNKSGDLSMNLLRHEDRPQRRSSVKKIEKMKEKRQAKYSENKLKCTKARNDYLLNLAATNAAISKYYIHDVSDLIDCCDLGFHASLARTFRTYLSAEYNLETSRHEGLDVIENAVDNLDSRSDKHTVMDMCNQVFCPPLKFEFQPHMGDEVCQVSAQQPVQTELLMRYHQLQSRLATLKIENEEVRKTLDATMQTLQDMLTVEDFDVSDAFQHSRSTESVKSAASETYMSKINIAKRRANQQETEMFYFTKFKEYVNGSNLITKLQAKHDLLKQTLGEGERAECGTTRPPCLPPKPQKMRRPRPLSVYSHKLFNGSMEAFIKDSGQAIPLVVESCIRYINLYGLQQQGIFRVPGSQVEVNDIKNSFERGEDPLVDDQNERDINSVAGVLKLYFRGLENPLFPKERFQDLISTIKLENPAERVHQIQQILVTLPRVVIVVMRYLFAFLNHLSQYSDENMMDPYNLAICFGPTLMHIPDGQDPVSCQAHINEVIKTIIIHHEAIFPSPRELEGPVYEKCMAGGEEYCDSPHSEPGAIDEVDHDNGTEPHTSDEEVEQIEAIAKFDYMGRSPRELSFKKGASLLLYHRASEDWWEGRHNGVDGLIPHQYIVVQDMDDAFSDSLSQKADSEASSGPLLDDKASSKNDLQSPTEHISDYGFGGVMGRVRLRSDGAAIPRRRSGGDTHSPPRGLGPSIDTPPRAAACPSSPHKIPLTRGRIESPEKRRMATFGSAGSINYPDKKALSEGHSMRSTCGSTRHSSLGDHKSLEAEALAEDIEKTMSTALHELRELERQNTVKQAPDVVLDTLEPLKNPPGPVSSEPASPLHTIVIRDPDAAMRRSSSSSTEMMTTFKPALSARLAGAQLRPPPMRPVRPVVQHRSSSSSSSGVGSPAVTPTEKMFPNSSADKSGTM

SEQ ID NO: 578 - protein, 870 aa, Homo sapiens
MNHLNVLAKALYDNVAESPDELSFRKGDIMTVLEQDTQGLDGWWLCSLHGRQGIVPGNRLKILVGMYDKKPAGPGSGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 579 - protein, 484 aa, Homo sapiens
MIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 580 - protein, 487 aa, Homo sapiens
MASSAEGDEGTVVALAGVLQSGFQELSLNKLATSLGASEQALRLIISIFLGYPFALFYRHYLFYKETYLIHLFHTFTGLSIAYFNFGNQLYHSLLCIVLQFLILRLMGRTITAVLTTFCFQMAYLLAGYYYTATGNYDIKWTMPHCVLTLKLIGLAVDYFDGGKDQNSLSSEQQKYAIRGVPSLLEVAGFSYFYGAFLVGPQFSMNHYMKLVQGELIDIPGKIPNSIIPALKRLSLGLFYLVGYTLLSPHITEDYLLTEDYDNHPFWFRCMYMLIWGKFVLYKYVTCWLVTEGVCILTGLGFNGFEEKGKAKWDACANMKVWLFETNPRFTGTIASFNINTNAWVARYIFKRLKFLGNKELSQGLSLLFLALWHGLHSGYLVCFQMEFLIVIVERQAARLIQESPTLSKLAAITVLQPFYYLVQQTIHWLFMGYSMTAFCLFTWDKWLKVYKSIYFLGHIFFLSLLFILPYIHKAMVPRKEKLKKME

SEQ ID NO: 581 - protein, 1034 aa, Homo sapiens
MALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVVGWQLKNLVNALREDPSGVILTLKKRPQSMLTSAPALLKNMRWKPLALQPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYGKLRPISMPVEYNWVGDYEDPNKMKRDSRRENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKSESREEKLGDSLQDLYRALEQASLSPLGEHRISTKMEYKLSFIKRCNDPVMNEKLHRLRILKSTLKAREGEVAIIDKVLDNPDLTSKEFQQWKQMYLDLFLDICQNTTSNDPLSISSEVDVITSSLAHTHSYIETHV

SEQ ID NO: 582 - protein, 420 aa, Mus musculus
MDTKRCFANRFDDYQGSLLAGQCEEAVAPLVTSTIERILQELPPLGGGAEARGATGAGSSCQGGLYSGVAGVAYMLYHVSQSPLFAAARERYLRFAKRLIDACLRAEEWGETDADTRAAFLLGGAGVYAVATLVYHALGRPDYVQPLGKFRALCAVCAPVSFLDCGSDELFVGRAGYLCAALVLKQKLAQEVLTPTQIKAICQAILDSGKQYALKKRKPFPLMYSYYGTEYLGAAHGLSSILQMLLSYQEHLKPSDRELVRQSVDFLMEQEQNCNWPPELGETIERENELVHWCHGAPGIAYLFAKAYLISKKPQYLDTCIRCGELTWQKGLLKKGPGICHGVAGSAYVFLLLYRLTGNSKYIYRAQRFAQFLFTEEFKSGSRVLESIYSLYEGFSGTVCFLIDLLQPNQAEFPLFSVFV

SEQ ID NO: 583 - protein, 579 aa, Homo sapiens [sequence omitted]

SEQ ID NO: 584 - protein, 1129 aa, Rattus norvegicus
MHPSMFLTVYLSNSEQHFTEVPVTPETVCRDVVDLCKEPGESDCHLAEVWCGSERPVADNERMFDVLQRFGSQRNEVRFFLRHERPPNRDIVSGPRSQDAGVKRNGVKVPGEHRRKENGVNSPRLDLTLAELQEMASRQQQQIEAQQQMLATKEQRLKFLKQQDQRQQQQAAEQEKLKRLREIAESQEAKLKKVRALKGHVEQKRLSNGKLVEEIEQMNSLFQQKQRELVLAVSKVEELTRQLEMLKNGRIDGHHDNQSAVAELDRLYKELQLRNKLNQEQNAKLQQQRECLNKRNSEVAVMDKRVNELRDRLWKKKAALQQKENLPQAVSAPSRVAAVGPYMQSSTMPRMPSRPELLGKPALPDSSLVMQSAEGPMKIQTLPNMRSGAASQSKGPKAHSASSDWNPSSTDLLPSQGSGSALDQVDEGEIALREKEKKVRPFSMFDTVDQCAPPPSFGTLRKNQSSEDILRDAQTVNKNVAKVPPPVPTKPKQINLPYFGQTAQSSSDVKPDGNPQQLPIAATSMGAKLKPAGPQARVLLSPSAPSGGQDQVLSPASKQESPPAAAVRPFTPQPSKDTFPPAFRKPQTVAASSIYSMYTQHQVPGKNFQQAVQSASTKTHPRGPHFSSVYGKPVIAAAQNPQQHPENIYSCSQGKPGSPEPETEPVSSVHESHENERIPRPLSPTKLLPFLSNPYRNQSDADLEALRKKLSNAPRPLKKRSSITEPEGPNGPNIQKLLYQRTTIAAMETISVPSYPSKSPSSVTVNPESPIEIPNPYLHVEPEKEAGSLVPEPLSPEDMGSASTENSDMPAPPPGLECVSEGVPDNSTTLQDNTEGTNPEAPHLLEVYLEEYPPYPPPPYPSGEPEVSEEDSARMRPPEVTGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYQPQHDDELLLKEGDCMAVVRREDEDETEWWWARLNDKEGYVPRNLLGVSRPNADHVSCVINEAWYELLCRGRAVY

SEQ ID NO: 585 - protein, 960 aa, Rattus norvegicus
MLSGERKEGGSPRFGKLHLPVGLWINSPRKQLAKLGRRWPSAASVKSSSSDTGSRSSEPLPPPPPPHVELRRVGAVKAAGGASGSRAKRISQLFRGSGAGGAGGPGTPGGAQRWASEKKLPELAAGVAPEPPLPTRAAVPPGVLKIFAAGLASGANYKSVLATERSTARELVAEALERYGLTGGRGAGDSGCVDAYALCDALGRPAAGVGGGEWRAEHLRVLADAERPLLVQDLWRARPGWARRFELRGREEARRLEQEAFGAADADGTNAPSWRTQKNRSRAASGGAALASPGPGSGSGTPTGSGGKERSENLSLRRSVSELSLQGRRRRQQERRQQALSMAPGAADAQMVPTDPGDFDQLTQCLIQAPSNRPYFLLLQGYQDAQDFVVYVMTREQHVFGRGGPSSSRGGSPAPYVDTFLNAPDILPRHCTVRAGPEPPAMVRPSRGAPVTHNGCLLLREAELHPGDLLGLGEHFLFMYKDPRAGGSGPARPPWLPARPGAAPPGPGWAFSCRLCGRGLQERGEALAAYLDGREPVLRFRPREEEALLGEIVRAAASGAGDLPPLGPATLLALCVQHSARELELGHLPRLLGRLARLIKEAVWEKIKEIGDRQPENHPEGVPEVPLTPEAVSVELRPLILWMANTTELLSFVQEKVLEMEKEADQEGLSSDPQLCNDLELCDEALALLDEVIMCTFQQSVYYLTKTLYSTLPALLDSNPFTAGAELPGPGAELEAMPPGLRPTLGVFQAALELTSQCELHPDLVSQTFGYLFFFSNASLLNSLMERGQGRPFYQWSRAVQIRTNLDLVLDWLQGAGLGDIATEFFRKLSIAVNLLCVPRTSLLKASWSSLRTDYPTLTPAQLHHLLSHYQLGPGRGPPPAWDPPPAERDAVDTGDIFESFSSHPPLILPLGSSRLRLTGPVTDDALHRELRRLRRLLWDLEQQELPANHRHGPPVAATP

SEQ ID NO: 586 - protein, 505 aa, Homo sapiens
MASGRRAPRTGLLELRAGAGSGAGGERWQRVLLSLAEDVLTVSPADGDPGPEPGAPREQEPAQLNGAAEPGAGPPQLPEALLLQRRRVTVRKADAGGLGISIKGGRENKMPILISKIFKGLAADQTEALFVGDAILSVNGEDLSSATHDEAVQVLKKTGKEVVLEVKYMKDVSPYFKNSTGGTSVGWDSPPASPLQRQPSSPGPTPRNFSEAKHMSLKMAYVSKRCTPNDPEPRYLEICSADGQDTLFLRAKDEASARSWATAIQAQVNTLTPRVKDELQALLAATSTAGSQDIKQIGWLTEQLPSGGTAPTLALLTEKELLLYLSLPETREALSRPARTAPLIATRLVHSGPSKGSVPYDAELSFALRTGTRHGVDTHLFSVESPQELAAWTRQLVDGCHRAAEGVQEVSTACTWNGRPCSLSVHIDKGFTLWAAEPGAARAVLLRQPFEKLQMSSDDGASLLFLDFGGAEGEIQLDLHSCPKTIVFIIHSFLSAKVTRLGLLA

SEQ ID NO: 587 - protein, 763 aa, Xenopus tropicalis
MKGGALHCRCSKCFAAPPKRRVKRRPRVLTLLSLPEDVLLYVLECLPAVDILSMREVHPHLRSLVDSHSSVWARASFQDVWPSPENLNLFERAAECGNFEACVKLGIAYLYNEGLSLSDDGRAEVNGLKASRFFSLTERLNSGADPFVWLFIRPPWSSSGSCCKAVVFDSLKEECGTVTSEEGATGALKGSIQYCLAKVLSLFEDDDKKREALGMLESSASHGCLHSSYLLWETKQKTALSDPGRYLQSFRQLRDYAARGCWDAQISLAKACGHKNQLSQEQRSASELVNQVFQSSLPINKTSIFTTQKGMNDTMRYILIDWLVEVATMKDFSSLCLHMTVGLVDRYLKLRSVPRAKLQLVGIACMVICTRFISKEILTIREAVWLTDNTYKYEDLVRMMGEIISALEGKIRMPTVVDYKDVLSHLIPLDRSTLHLCSYISELSLLYTELSTYSPAQLAAGALLLARILHKQARPWPAQLAETTGFTLEHLTPCVVLLHKKCFHDDAPKDYRQVSLTAVKQRFQDDLYDQISKEKVMDHSHLCELLGVPCRDSESPASCPNAADFHQFLCSPSGSKTKRRREDSIQEDRGSFVTTPTAELSNQEEDLLGDFLDWSLETSCSGYEGDRESEGEREGEVTAPSGVLDLSLLITEHQQCQDTTSDDDSLVPLHPIPLLSKLENGTHSTEGCAEKSSGYSSVSSGGSPTSSSSPPGLPFTPTPGLNHSKLMPIPFPQPCSPLFKASRRQVKRKNQAQHSEDNLSDEL

SEQ ID NO: 588 - protein, 320 aa, Mus musculus
MSAPEGLGDAHGDADRGDLSGDLRSVLVTSVLNLEPLDEDLYRGRHYWVPTSQRLFGGQIMGQALVAAAKSVSEDVHVHSLHCYFVRAGDPKVPVLYHVERIRTGASFSVRAVKAVQHGKAIFICQASFQQMQPSPLQHQFSMPSVPPPEDLLDHEALIDQYLRDPNLHKKYRVGLNRVAAQEVPIEIKVVNPPTLTQLQALEPKQMFWVRARGYIGEGDIKMHCCVAAYISDYAFLGTALLPHQSKYKVNFMASLDHSMWFHAPFRADHWMLYECESPWAGGSRGLVHGRLWRRDGVLAVTCAQEGVIRLKPQVSESKL

SEQ ID NO: 589 - protein, 989 aa, Gallus gallus
MRAEGAGLLRGRDVDGASAMAAAKPGTGTNLLFASSATEFNFTVPFIPVSQAPAAPPGPALLTADDSADVGEEDSFLGQTSASPNPPQTFNYFSQVPSSSDPFGSIGQPPLTSSAPPVGAAAFSRPPTSLPLVTGSQDGQNAFSPQLPKSQSSSGPPPTSQVGITGYQTPQQSCPPPANASALPSQQGYNPYRHTTLSSRANPYLTPPQLQQGHAPTPPVHPPSSVPPVQMYQTPPGPLTQNQYEPVQPHWFYCKEVEDKQIWMPFSILDSAKLEEVYNSVQPDPESVVLSTDGGRYDVYLYDRMRKAVYWEEEPSEVRRCMWFYKGEKDSRFIPYTEDFSDKLEAEYKRAVTTNQWHRRLEFPNGETIVMHNPKVIVQFQPSATSDEWGTSQDGQARPRVVKRGIDDDHDEIPDGEMSQVDHLVFMVHGIGPVCDLRFRSIVECVDDFRTVSLKLLQTHFRKSLEEGKVSRVEFLPVHWHSSLHGDATGVDRNIKKITLPSIGRLRHFTNETLLDILFYNSPTYCQTIVDKVGMEMNRLYALFMSRNPDFKGGVSVAGHSLGSLILFDILSNQKDLASSVNTEPFSGVNGTEKDMSTQDKQMTEDTSSLGSSITTSGDDLCEPEVDDDVPTLQKTLEMLSLSEYANTFEKERIDMESLLMCTIDDLKEMGIPLGPRKKIANFVKDRAAKQEQKKAAAEKKAALAAMLQTQEVSQKAKETVTSVSPSESGQQHSKRKLPVGASVSSVNVDYEYFEVGTGQVSVVYSALDFEPDTFFALGSPIGVLLTVRGLEKIDENYRLPTCKGFFNIYHPLDPVAYRIEPMIIEDLSLKPVLIPHHKGRKRLHLELKDSLSRMGSDLKQGFISSLKSAWQTLNEFARAHTSSTQLQAELEKVANQIKEEEEKQVVEAEKITESPDLPKDEDFTVKVGMLNGGRRIDYVLQEKPIESFNEYLFALQSHLCYWESEDTALLFLKEIYRMMNINPEQPQH

SEQ ID NO: 590 - protein, 385 aa, Xenopus tropicalis
MKWVILAFVCLQISEGLIRVPLHKSKTIRETMKEKGVLKEFMKTHKREPAMKYKYNLKNDFAIAYEPMYMDAAYYGQISVGTPPQNFMVLFDTGSSNLWVASTYCQSGACQNHPLFNPSQSSTYTSKNQQFSITYGSGSLTGVFGYDTVTVQGLSITNQEIGLSINEPGTNFVYSSFEGIFGMAYPALAAGGATTPMQGMLQQNLLTYPIFSVYMSSQSGEVIFGGVDSSLYSGQIYWAPVTQELYWQIAIDEFSINGQATGWCSQGCQAMVDTGTSLLTVPQQFMGTFLQSLGAQQNQYGEYIVNCNNVQSLPPISFTINGVQFPIPPSAYILQNNGYCSVGVEVTYLPSQNGQPFWILGDVFLRQYYSVYDMGNNRVGFAQSA

SEQ ID NO: 591 - protein, 219 aa, Xenopus laevis
MANVSIRKYKNSDYETVNFLFVEGTKEHLPAACWNTLKKPRFYFIIIVACASIFMCTSSYVLSLTSLVALLAVGWYGLYLEFHGYASRCQREDMLDIENSYMMSDNTCFWVAEIDRKVVGIVGAKPLKEADDELFLLHLSVARDCRQQRIGTKLCQTVIDFARQRGFKAVCLETANIQDAAIKLYEAVGFKKSLVAIPPFLLNQYTSFTVIYYRYDIKS

SEQ ID NO: 592 - protein, 518 aa, Xenopus laevis
MPLFGSNPFDQDVEKATNEYNTSEDWRLIMDICDKIVNTPNGAKDGLRSIMKRVNHKVPHVALQALTLLGACVSNCGKAFHLEICSREFASEVRSVITKAHPKVCDKLKALMVEWEQELQKDPQFSLISATIKSLKEEGISFPSSAPQSTSNTPTKGKEEDDIAKAIELSLQEQKQQSYETKTIYPSVDALHDSQKTARKVRALYDFEAVEDNELTFKSGEIIIVLDDSDANWWKGENHRGVGLFPSNFVSSSLNAEPEEVVEKNLVLEEISESAPKSEPEPVFIDESKMDQALQLLQSIDPTDPKPDSSALLDLEDVCQQMGPMIDERLEEIDRKHSELSELNVKVMEALQLYNKLMNEAPMYSVYSKPPAQAHYTAGVSMQSYHSQPQGGSFMVQNMPQVQPATLSQGYSMTPDQIGSLRSLPPAMNSTVTTQAAQPPYASSGQEAVSASPYINQSTGLQTATGVPAYGQPMAMSSDASAYQNTTSALPPGSGYSVPASLHSFPPQPQNYYQQPLL

SEQ ID NO: 593 - protein, 1696 aa, Xenopus laevis
  misc_feature (361)..(361): Xaa can be any naturally occurring amino acid
  misc_feature (836)..(836): Xaa can be any naturally occurring amino acid
SVGDEEDIPMGSSLGSPMLSDLDIKLQEIARAGLVVSGQEYPYSGSQELFDIAARFHHQPGSPISLLDESSSVTDRDKNAEVVSKKPPGNVISVIQHTNSLSRPNSFERSESTELLACQQDKPSSPSEACDSGNTMSSISPEWTQSGDISDASARPSPSQQSQQTAYHMPPRLVRQHNITVPEIRVTEEPDKPEKEPEIPVKEPEKTPEEFQWPQRSETLSQLPAEKLPPKKKRLRLADMDNSSGESSFDSTGTSLSRSPSQESNLSHSSSFSMSFDREEILKVATFTKQDEITKQTEFLTVPPGSYSLSVPGQPHHKEMRRSSSEQIPCPSLTEIPEIRSKSFDYGNLTHASASGATTTXLSPNRERKKCFLVRQASFSGFPENTQTEQETAGNQEPSEQAHTCRRSSQILWHNSSSSLSCSISVLSEDTANIPIGTSAQPTTSTSSHYSQSVGTHDPLLHKTPYVPKRHLQEQQNTFIHPDKTVYPPVHNAFQLPYTSVCMAQLPIHHPFMWPTCADPLQRHFEHHLQQLQKTYFKQPSQSDIHSYYLDPTQDLTGSKSVSYMHGGEKSYHAYLETSAQRSKNTVSKLQRDHSGGSSDSTDQSLQIVSVSQSTGSLQNLPGAVVPVRIHTHVPSYGSVMYTSISQITHAQTSNPPIVICKVDGNTSQRTLATNASMKGLGFSIAQMLGPCGSIEHPIWKVPPAFDLDTAIPLCLASNSDSVATFGAGKRMLSPASSLELFMETKQQKRVKEERMYGQIVKELSAVELTNSDIKKDLTRTSKPQLVRQGRTTEQKDNLPSIGSSPPLLSSDSPQSILLDVAESKSSDSPEGRMSXDELYBEETASNMSLSPQGTPSEFFEENPLKSQKKSVSILGLSIADGATIGPLKDGSELHNILQFPSLRTLTTVSWCFLNYAKPSHVEQTTLKSSVYASWCISSCNPNPTGLNTKTSLALLRSKQRNAVEVYTIAAMNRFGAGKLTSSNVWKQQFAQMKPEPSLLVSSKLEKKAAGNSKERTKGESHGEKDISAKQTEPMRIKIFEGGFKSNEDYVYVRGRGRGKYICEECGIRCKKPSMLKKHIRTHTDVRPYVCKLCNFAFKTKGNLTKHMKSKAHMKKCLELGVAMTSVDDAEAEESGNTEDTQKESDKSSPAIDHQFSDAEESDVDDGDDNDDEDDDDEDFDDQGDITPKTRSRSTSPQPPRFSTLPVTATSASQRASPEASIGHSSLMSYLSTMPSIQITHLMSKSAMCGDSQMMEYQRLFLQDMEHERGKMDVPVGMDEDFMLTSEPSSSPKDLSSYSRHSSPGYDSSPCRDNSPKRYLSLRGDMSPRRHLSPRRDASPMRHLSPRKEAAIRRELSPRRDVSPRRHLSPLRPMSPGKDLSSGRDISPRRERKYMATFRALSPRRRLHNTYIHNTSLPMSHYLHSDSGFLGHGRQNWPPVPYTSHHPETVPGQQSPGQALETHRDYIFSHLPLHSQQQVRAPLPMIPIGGIQMIHSNSTIQSSSHSSTATQLHLKSSDEKRSMSSESCPSIPLHLDKHSSNVSLKDSSSESDSTLLPSLGQSPTDESSQHNEREQEENIRTCTKAIACLRIATEEGLPQKRELLSCPEPNQKTECAQLSIRHFSGLEAGTALSSVSTTYVELYGDNDSLGTSQSTTAHSKFYSKTMDMKKLGYHGRKDEPPSVQEVKDTAESSKPH

SEQ ID NO: 594 - protein, 1065 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 595 - protein, 780 aa, Homo sapiens
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLHSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSGAGNPKCKIAIVLGRTQNTSLSRHKQHSMILVPMNTPGVKIIRPLSVFGYTDNFHGGHFEIHFNQVRVPATNLILGEGRGFEISQGRLGPGRIHHCMRTVGLAERALQIMCERATQRIAFKKKLYAHEVVAHWIAESRIAIEKIRLLTLKAAHSMDTLGSAGAKKEIAMIKVAAPRAVSKIVDWAIQVCGGAGVSQDYPLANMYAITRVLRLADGPDEVHLSAIATMELRDQAKRLTAKI

SEQ ID NO: 596 - protein, 2932 aa, Xenopus laevis
MNGDMPHVPITTLAGIASLTDLLNQLPLPSPLPATTTKSLLFNGRIAEEVNCLLTCRDEPLVSQLIHSLNQVSTDHIELKDNLGSDDPEGDIPVLLQATLARNPNVFREKSLQNRYGVQSGLMIPPYKLPQNSMHGSPASSNYQQTTISHSPSSRFVPPQSSSTNRFIGQQNSPVPSPYAPQSPAGYMPYSHPGGYPQHQGLQQASVSSPIVAGGLRNLHENKVSGQLSGSSANHHADNSRHGTTEDYLQMVHRLGGEDSDSSIRNAASFSLRSPQSVCSPAGSEGTPKGSRPLILQTQPPPYSSPRDAPPDILLDSPDRKQRRPKKLKLSKDDKEQTEKSAMYDIISSPSKDSTKLTLRLTRVRSSEMDQQGDMLSNMENSNLSEGDAAFNAQFPGNASKTPVTPQDLSRPLNAAACFQEQSEFLQVQQVPVLQPNTSAAAKPPQPLVAQSQPQQTGNITPYDEVELDALAEIERIERESAIERERFSKEVQDKDKPLKKRKQDSYPLEAGGATGGNRPASQETGSAGNGSRPALMVSIDLQHAGRGDSQATVTQDSDCARKADNIKNCNDGYISGPQEDTVFKHNPENHPLRKSESDMECPDKSIKSTTANLSTERGLEKSLNETKLCDIKSEPVECSEEAKVSSDCPTEAKSESCEVDYDDSMMDFKNSEGSNEDIKTEALLNETSNDVKSFDLQDESKENGNQSKSSKIDNRLEIRQKQKQNDGQPETPRQKFEGKSEALQQKVEVKSEASKQKAEGKPETIRQKSEVKSDTLKQKTEGHPETPKQKNENKPETPKQRSDSKPETQKQKNDSKPDTPKQKSEGRPETPKQKSESRPNTPKQKSEGRQDTSRQKNEGRQEINRQKSEEHKSDGRPETPKHKHDMKKDSNRLSTEKKPDLSKHKTDSKSDSPRVKPEGRTDGVKQRIDGRPSHESSKRDCDNPKQKHDDKGESEKHKGEMSRLRRPESLRSFSKNDQETRPGSKPDTPKMDKAEKKHRRDSDDSREKHSSGEQKQRPGSPRIKQDSKSDPNKSDSSKLKSDKPALKSPTGKEEKRTDGNKSKVEGNKGHSDNKTGFPSYLLGGNQGTLKNFVIPKLKRDKDGNITQESKRSESKGEQMDKPEKMGFVEDLNKGAKPVVVLQKLSLDEVQKLIKERDDKSKGSLKSNKNRPSKSSKGGIDQSVLKELPPELVAEIESSMPLCERVKMNTRKRGAVKEKPKYTEISSGEDEEREETFEPSRKRPKKGKSDADWQYDGERERRSSGDHRRSGNDSRRGSRYRERSAEDSEMEDSPPPPRLSEVARRLKKERQKKRKAYEPKLTPEEMMDSSTFKRFSSAVENILENLEDMDFSAFGDDDEIPQEMLLGKHQLSELGSESAKIKSMGIMNKISSEKMVKLLGILEKNIQDGSKLSTMLNHNDTEDEEKLWRDLIMERVTKSADACLTAINIMTSQSMPKAVYIEDVIEHVIQYTKYHLQNTLYPQYDPVYRVDPHGGGLMSSKAKRAKCSTHKQRVIVMLYNKICDIVASLSELLEIQLLTDTTILQVSSMGITPFFVENVSELQLCAIKLVTAVFSRYEKHRQLILEELFTSLARLPTSKRSLRNFRLNSSDDAGESMYIQMVTALVLQLIQCVVHLPSDKDNAEEESNKKIDQDVFITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSINRILKQASEGDEIQQLQKALLDYLEENTETDPSLVFSRKFYIAQWFRDTTMETEKAMKSQKDDDEGTLHAKEVESTGDIMRQAEKRKKFLRNIIRTAPSQFSTLKSNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYEMLIERILDTGISVRKRVIKILRDICLEQPTFPKITEMCVKMIRRVNDEEGIKKLVNETFQKLWFTPTPQNDKEAMTRKILNITDVVAACRDTGFDWFEQLLQNLLKSEEDASYKPVKKACTQLVDNLVEHILKYEESLADSDSKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNYKFVWACFNRYYGALLKLKSQHQEDPNNTILTTNKPALLRSLFTVGALCRHFDFDQEEFKGSSKVNISVNIKDKVLELLLYFTKHSDEEVQTKAIIGLGFSFIQHPVLMFEVEVKNLYNSILSDKNCSVNLKIQVLKNLQTYLQEEDTRMQQADRDWKKMSKQEDLKEMGDISSGMSSSIMQLYLKQVLESFFSTQSSVRHFALNVIALTLNQGLIHPVQCVPYLIAMGTDPEPSMRNKSDQQLVEIDKKYTGFIHMKAVAGIKMSYQVQQAIISNANQIVRGFRKDETNSALCSHLYSMIRGNRQHRRAFLISLLNLFDDAAKTEVNMLLYIADNLACFPYQTQEEPLFIMHHIDITLSVSGSNLLQSFKESMVKGKQKVKAASSNEENSSESDEEVIRPKKTRRRGNDESDSDGEDDVEHVLRCLPNNASPLIEFANASQGILLLLMLKQHIKNLCGFSDSKIQKYSPSESAKVYDKTINRKHAVLFRPKQTLEYLKRNMTCAKINDEVKRSIAKQYLDFKMLMEHLDPDEEEEEGEVSASTDARNKAITNLLGGNSPKNNVAETEEEESDGEEKAGGTSGLRKSKRLSDSSDAAVQMNETVDVQDVIAICCPKYKDRPQIAKVVQKTSHGFSVQWMAGSYSGPWAEAKRRDGRKLVPWVDTIKESDIIYKKIALTSANKLTNKVAQTLRSLYAAKDGTSS

SEQ ID NO: 597 - protein, 1135 aa, Xenopus laevis
MAANEKMEVTVKTLDSQTRTFTVETEISVKDFKAHISSDVGISPEKQRLIYQGRVLQEDKKLKEYNVDGKVIHLVERAPPQTQPSTGGPSTSSSTSPTSSNAAPVPGAPERNGNSYVMVGTFNLPHVMSGLVRQQRPSVSTVNGNDGSTLDVHINLDQQLPVQSEPRVRLVLAQHILQDIQRILDRLEGQAVNEQAAEPMDTAESEGEASSRETLPQTTQNTDGQSNTTPTSHPSPSEYVEVLQSLSRVEERLAPFMQRYREILSSATSDAYENQEEREQSQRIINLVGESLRLLGNALVAVSDLRCNLSSASPRHLHVVRPMSHYSGPMLLQQAAIPIQINVGTTVTATGNGTHAGHMPSDGNAAQPPSTNTSEPQRPNTENQPPSNGERPASDAPPTSVPHPHPRVIRITHQTVEPVMMMHMNIQDSASGGPTTIPPPTAGHGGSAHIHMPGLPPEFMQAISHQITQQAMAAASGQQIPGFQAPPRFVFTRPAAPSFQFQPGTATTPPGPGGATTTVPGATVGPAGNASLAQMISGLVGQLLMHPVVVAQGGSSTSSSTSSSTFTSTSSSASSSSSTDTTSTTTTSSTANPTVSSVPSSQPPPGTDQHLSQLLGSLLGTASSGMSNITMGSPSITVTVPGMPAFLQGVTDILQATQTVPVSTAPTQSASQAPPPSSPPPPPAHSSPPPAAAPESLPPEFFTSVVQGVLSSMLGSLSAADQSGTESIAAFIQRLSGTHNIFQPDAEGPGGFFGDLLTLICHNFSLVDMVMLLHGHSQPLQNLQPQLRSFFLQEYLHQVDPTPNNIQMASRNLTNGLEEYIRESFASVTVRDDVDITRTNIEFLQDQFNRITTHILHCADSTFGQRLLEMCNQSLFEWLALNLYCLRGDQNALTSVINERIRRLSLDVSPVLVSWVTSVLSLRLQVLLGQMPVTEGEIQRHVRRVGDAPQVPEPSSQEQPMETMPVDCQNGAASPVLATHSGGVLFLPPQSSVPTICPDSDHPTQEDGGSEQWAASVPPEWVPVIRQDMQNQRKIKQQPPLSDAYLSGMPAKRRKTMQGEGPHLSLSEAVSRAMKATGAKPESSAECVRRELDNSEAQGRYREQLCQDIQKTLQDNESYSAQRFPNTQRAFRGDP

SEQ ID NO: 598 - protein, 706 aa, Xenopus tropicalis
MEPIPPDSDLFLTHREAEGSIRKGCDPFAQTQRSKLQHRRARINQQINKEMRMRAGAENLFRATTNHKVRETVALELSYVNSNLQLLKEELEELNSSVEIYQNESDAINVPMIPLGLKETKELDLTDALKDFIVHHYGDDGTLYDKEIREFMDLRQAMRTPSRSDAGIELLMEYYNQLYFLDNRFFPPNKPLGVFFHWYDSLTGVPSCQRALAFEKGSVLFNMGALYTQIGARQDRLSVEGVDTAIDAFQKAAGCFSYLKENFSNAPSLDMSTASLSMLVRLMVAQVQECIFEKFVLQNPRSDFFTQLQAAQEAARVEEVYTLVYRTMTQPPVKDYIPFSWSTMVHVKAEHFRALSHYYAACALCDYSTASEAEVKTQEKAFSQFHVTAPEGPSVGFVLQDPEERRKLGKAHLKKAIMKHEEAMRIHVLSKILRKMDILQEVLTLTHKQSLSKYSDIDHEEDFFETGEAPDIQPITCQRPEIKTPVFSKVKATDIFHRLGPLSVFSAKHKWRPPQKVHLEKGDDGFGFTLRGDAPVLVAGIVPGGCAAEAGVMENSYIVSVSGADCRWAKHAQVVQQLKDAGEDGVDIEVVVFQNPETQIMLWGPQSSFSWQRGAHGWAGHVPQQWDYNASPSLSLSQVVDKRASMLTACELLRGNKENNKKSILGSKSASALRLWSKRSKSSKRNLNSNVVHLPFSAVQNSESMY

SEQ ID NO: 599 - protein, 314 aa, Xenopus tropicalis
METRVQNGNVSQPLLPARRDSERLHSDADPREILTQQVHVLSLEQIRAIRNTNEYTEGPTVAPRPVIKSAPRQTTPHKNERIHVVNEQRPFVRSPLPPMHSLSQAPLSRSVGTVTSSCRSNTRTSSSSTEQRLLAPPFTSSGLVADRIIRVQPKPELKSDILKPSSKEELGLHSLRCEDCGKCKCQECTYPRTLPSCWICDKQCLCSAQEVVDYGTCACCVKCLFYHCSNDDEDNCADNPCSCSQSHCCTRWSAIGVMALFLPCLWCYLPAKGCLKLCQGCYDRTNRPGCRCKRSNTVCLKVPHLQPRNLEKPT

SEQ ID NO: 600 - protein, 338 aa, Xenopus tropicalis
MFSRIARPASHGLIRGLSTTAQANARVAVLGASGGIGQPLSLLLKNSPLISNLTLYDIAHTPGVAADLSHIETRAKVTGYLGAEQLPESLKGADVVVIPAGVPRKPGMTRDDLFTTNASIVATLTEACAKHCPEAMICIISNPVNSTIPITSEVFKKHGVYNPNHIFGVTTLDIVRANTFVAELKGLDPARVNVPVVGGHAGKTIIPLISQSTPKVEFPQDQLEALIPRIQDAGTEVVKAKAGAGSATLSMAYAGARFVFSLLDAMNGKEGVIECSFVRSEETESPYFSTPLLLGKNGIEKNLGLGKLTAFEEKLVSEAMGELKASIKKGEDFIKSRK

SEQ ID NO: 601 - protein, 642 aa, Xenopus tropicalis
PSFYVRAVGPCSRIVRGWVESQKTRCRGAHAVRVLSGQMERLPPAVREFVVKGAELCDPQNIHICDGSATENETIVTVLQQEGMLKKLHKYPNCWLARTDPKDVARVESKTVIVTENMRDTVPIPTTGVKGQLGNWMSPQDFERAKAERFPGCMRGRTMYVLPFSMGPVGSPLSKYGVQLTDSPYVVASMRIMTRMGSQVLDALGDGEFVKCLHSVGQPLPLKAPLVNSWPCNPEKTIIAHVPDSREIVSFGSGYGGNSLLGKKCFALRIASRIAKDEGWLAEHMLILGITNPAGRKRYIAAAFPSACGKTNLAMMRPSLPGWKVQCVGDDIAWMKFDSEGRLRAINPENGFFGVAPGTSAKTNPNALSTVERNTIFTNVAETSDGGVYWEGLDQPLPPGVTVTSWLGKSWKPGDKEPCAHPNSRFCAPAAQCPIMDDAWESPEGVPIDAIIFGGRRPEGVPLVYESYNWNHGVFVGASMRSEATAAAEHKGKVIMHDPFAMRPFFGYNFGQYLSHWLSLQKRPGLQLPKIFHVNWFRKDADGGFLWPGFGENARVLDWIFRRVEGEESARQSAIGYLPAEGALNLQGLGGVDTNALFSLPKGFWEKEVQDVGKYLTEQVTDDLPPQIMEELRGLEGRVKQM

SEQ ID NO: 602 - protein, 436 aa, Xenopus laevis
MAGGTLYTYPDNWRAYKPLIAAQYSGFPIKVASSAPEFQFGVTNKTPEFLKKFPLGKVPAFEGKDGFCLFESSAIAHYVGNDELRGTTRLHQAQVIQWVSFSDSHIVPPASAWVFPTLGIMQYNKQATEQAKEEIKTVLGVLDSHLQTRTFLVGERITLADITVTCSLLWLYKQVLEPSFRQPFGNVTRWFVTCVNQPEFRAVLGEVKLCDKMAQFDAKKFAEMQPKKETPKKEKPAKEPKKEKEEKKKAAPTPAPAPEDDLDESEKALAAEPKSKDPYAHLPKSSFIMDEFKRKYSNEDTLTVALPYFWEHFDKEGWSIWYAEYKFPEELTQAFMSCNLITGMFQRLDKLRKTGFASVILFGTNNNSSISGVWVFRGQDLAFTLSEDWQIDYESYNWRKLDSGSEECKTLVKEYFAWEGEFKNVGKPFNQGKIFK

SEQ ID NO: 603 - protein, 400 aa, Danio rerio
MQNDSSAGFLPIYKSFATDAIHVGSEPEQWSSMAVVPPISLSTTFKQHGPGKHAGFEYSRSGNPTRNCLEKAVAALDGAKYCLAVASGLAATLTITHLFKSGDGILCMNDVYGGTNRYFRKVASEVGLDISFADLTKLEELKAGLKPNTKMVWIETPTNPTMKVVDIQACADIVHKHNKDTIVVVDNTFMSAYFQRPLALGADICMYSATKYMNGHSDVVMGLISLSRDDLYERLKFLQNSLGAVPSPFDCYMCNRGLKTLHLRMKQHFKNALAAAQFLEADPRVDRVIFPGLPSHPQHELTKRQCTGCPGMITFYIKGKLEHASTFLSNLKLFALAESLGGYESLAEHPAIMTHASVCEEERKKLGISDTLIRLSVGLEDEEDIIADLDQALGAAHPKK

SEQ ID NO: 604 - protein, 166 aa, Homo sapiens
MPWRGRRFRLCRRKMAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEPSKRSRGALGSIALLGLVGTTVCSAFQHLGWVKSGLGSGPKCCH

SEQ ID NO: 605 - protein, 586 aa, Mus musculus
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHDFSSPPHLLRTPSGASTVSVGSSETRGERVIDAVRFTLRQTISFPPRDEWNDFNFDMDSRRNKQQRIKEEGE

SEQ ID NO: 606 - protein, 422 aa, Gallus gallus
MEVEVRAHGAVLQRNGAHAQMLAERFNPWSSIPQRKGSVPDSSLSSSPYENHTKRQQCPANCWIRVQHSISSGLRRDVGDGGRLVPVPSLSEADKYQPLSLVIKKRKCLLSKKSKFASTPFTLKDILEGEKEISAGVSSYQLLNYEDKSDVSLNGRRGNQIINDVGFDVAGSDSIAFKASFGIVTKHEVEVPTLLKELTTRKINFDHCLVHQTRKSRMEILCVVMESIRTTRQCSLTVHTGMRGETMRFHIIEDQNNKGRDKAIVFPAHTTIAFSVFELYIRLDGNFELCVTPIAKGGFEKEKSGSSSMNKLRRLKHNLFHRNKRIVSIIPSSDGYLEDLFTDYYEKAASMTDLSTSYLREGAHARINLLNNNIPKGPCVLCGMGSSKRETVYGCLECSFNGQKYVRLHAVPCFDLWHKRVK

SEQ ID NO: 607 - protein, 421 aa, Homo sapiens
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRYNNYDRAVINTVPYDVVHRWYTAHRTLTIELRRPENEFWVKLKPGRVLFIDNWRVLHGRECFTGYRQLCGCYLTRDDVLNTARLLGLQA

SEQ ID NO: 608 - protein, 354 aa, Bos taurus
  misc_feature (51)..(51): Xaa can be any naturally occurring amino acid
MSLRSHLSRLLRTQVHSVRKKSVHSVAVIGAPFSQGQKRKGVEYGPAAVRXAGLMKRLSDLGCHLKDFGDLNFTPVPKDDLYNNLIVNPRSVGLANQELAEVVSRAVSGGYSCVTVGGDHSLAIGTISGHARHCPDLGVIWVDAHADINTPLTTSSGNLHGQPVSFLLRELQDKVPQLPGFSWIKPCISSPSIVYIGLRDVDPPEHFILKNYDIQYFSMRDIDRLGIQKVMEQTFDLLIGKRQRPIHLSFDIDAFDPTLAPATGTPVVGGLTYREGIYITEEIHSTGLLSALDLVEVNPRLAVSEEEAKATASLAVDVIASSFGQTREGGHIVYDQLPTPSSPDESESEERVRI

SEQ ID NO: 609 - protein, 364 aa, Homo sapiens
MEDKMWSECEGPEMSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKGEHGVKEVLNILTNEFHTSMALTGCRSVAEINRNLVQFSRL

SEQ ID NO: 610 - protein, 995 aa, Gallus gallus
MSAEAADREAATSSRPCTPPQTSWFEFLLEEDLLEQHLRKPSPDPPPVQLIVQFLEQASKPSVNEQNQVQPPPDNKRNRILKLLALKVAAHLKWDLDVLEKSLSVPVLNMLLNELLCISKVPPGTKHVDVDLSSLPPTTAMAILLYNRWAIRTIVKSSFPVKQVKPGPPQLNVMNQMQQEKELTENILKVLKEQAADSILVLEGALKLNKDLYVHTIRTLDLLAMEPGMVNGETESSTAGLKISAEEIQCQVCYDLGAIYFQQGATNAALHENAKEKFFKTKELIAKIGSSSLHCTIDEKRLAGYCQACGVLTSSDDDASQQTTPYNQIHNCMKSGNYQDLVKIFLEDNLALSLPVQFRQSVLRELFQKAQQGNDALDEVCFKICVCNTVCDVLQGQIIDIQFCQLFLKPNKEKIDFLLEVCSRSINLETASESLKRKMAAFLKNLCLGLEDLQLVFMISSHELFIKLLKDDERKLLVDQMRKRSLRINLSTKPVTSFYDIPASASVNIGQLEHQLILSVDPWRIRQILIELHGMTSERQFWTISNKWEVPNVYGNVILGIKDNLTRDLVYILMAKGLHCCAIKDFVHAKQLFAACLELVTEFSPKLRQVMLNEMLLLDIYTHEAGAGAAGERPPSDLISRVRGYLEMRVPDIPLRQVIAEECVAFLLNWRENEYLTMQVPLPLVQTNPYVKLGQLLAATCKELPGPKESRRTAKDLWEVVVQICSVSNQHKRGNDGRVSLIKHRESTLGIMYRSELLSFIKKLREPLVLTTILSLFVKLHNVREDIVNDITAEYISIWPSSIPNLQSVDFEAVAVTVKELVNYALTINSNNHFWLIIQADIYFATNQYSAALHYYLQAGAVCSDFFNKMVPPDVFTDQVIKRMIKCCSLLNCHTQVAILCQFLREVDYKTAFKALQEQNSHDAMDSYYEYIWDVTILEYLTYLHHKRGETDKRQIAIKAIGQTELNASNPEEVLQLAAQRRKKKFLQAMAKLYF

SEQ ID NO: 611 - protein, 640 aa, Homo sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 612 - protein, 1006 aa, Homo sapiens
GSVTASLSSRRPRPVLCPYRPRSQGRVLAMPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEEVINLVDQTSENAPTTVSRDVEEKPAHAPARPEAPVDSMLKDMATIILSTFLLIGWVAFIITYPLSMHQQQQLQHQQFQKELEKIQLLQQQQQQLPFHPPGDTAQDGELLDTSGPYSESSGTSSPSTSPRASNHSLCSGSSASKAGSSPSLEQDDGDEETSVVIVGKISFCPKDVLGHGAEGTIVYRGMFDNRDVAVKRILPECFSFADREVQLLRESDEHPNVIRYFCTEKDRQFQYIAIELCAATLQEYVEQKDFAHLGLEPITLLQQTTSGLAHLHSLNIVHRDLKPHNILISMPNAHGKIKAMISDFGLCKKLAVGRHSFSRRSGVPGTEGWIAPEMLSEDCKENPTYTVDIFSAGCVFYYVISEGSHPFGKSLQRQANILLGACSLDCLHPEKHEDVIARELIEKMIAMDPQKRPSAKHVLKHPFFWSLEKQLQFFQDVSDRIEKESLDGPIVKQLERGGRAVVKMDWRENITVPLQTDLRKFRTYKGGSVRDLLRAMRNKKHHYRELPAEVRETLGSLPDDFVCYFTSRFPHLLAHTYRAMELCSHERLFQPYYFHEPPEPQPPVTPDAL

SEQ ID NO: 613 - protein, 338 aa, Mus musculus
FPGPGSMAPPQRCPLCRQTFFCGRGHVYSHKHQRQLKGALERLLPQVEAARRAVRAAQVERYVPEHDRCCWCPCCGCEVRKHLSHGNLTVLHGGLLEHLASPEHKKATNKFWWENKANAQMKEKFLISPQDYARFKKSMVKGLDSYEEKEDEVIKEMAAQIREVEQSRQEVVRSVLEPQAESDPEEGSSAPESWKATNGHVASSSQQVSHLALQPVAELDWMETGQQLTFIGHQDTPGIGNIHSGATPPWMIQEEEHSSGSLPIGPSYEEFLKEKEKQKLKKLPPDRVGANFDHSSNTSAGWLPSFGRVWNNGRRWQSRHQFKTEAATRSKQPRKGKS

SEQ ID NO: 614 - protein, 104 aa, Schistosoma japonicum
MYVCLPTSRTYEIKKCITCTTKGVMYMLQCSCNTICIGKTSRALKVRLGEHKSTIRRQEITLPVARHFIEQRSINELRCVGIETVHPPRRDDDYDNKLLKREAM

SEQ ID NO: 615 - protein, 162 aa, Xenopus laevis
MENCLGFYSLPKLVLLLYGLTLLSLNLPVSGSQVNSFTSLWFLSEPSDVVTMRGGNIVLNCSAQSDRGPPIIKWKKDGVYLNLAIDERRQQLPTGSLLIQNVVHSRHHRPDEGVYQCEASLDGVGTIVSRTRKAIVAGPLRILSQTDVSTSFVGDTALLRCE

SEQ ID NO: 616 - protein, 464 aa, Xenopus tropicalis
IFPGLGYILEAICSVPPIRVADNVGTRILEEGYTSCQPCSASRRLKEQGEEMRHRGTRGPSAYIPVSQLTSPYMGDNIAAVMGLHPDYLHVFWKTQHQLLRMDGALSLPERHYVAIMASARHQCTYLVSLHSSCFLQVGGDHRWLEGLDAAPLKLRKLNDLNKILAHRPWLITKEHIEILLSSQGGHSWSLAELIHALVLLTHFHALSSFILGCGIYLPEDNNAVPRPPSPDIPLSVGNSTLQEAERVLAEIKKLDEEGEETSQEEMETRFEREKRECAMVPTNGDNSKPVCFPGILHFLEDPDFGYIDFTRRGEQAPPTFRAHDYTWEDHGYSLLQRLNPEVGQLLDDKFQVAFNLTYHTCATHSGVDTSKLRRAIWNYIQCIYGIRYDDYDYGEVNQLLERSLKVYMKTVTCHPERVTRQLYNDFWRQFKHSEKVHLNFLLLEARLQAALLYSLRAITRYMT

SEQ ID NO: 617 - protein, 364 aa, Gallus gallus
MDGAQIYLVTGGCGFIGEKITELLSQQDYIKEVRVFDSVARKEVEKFATATTHVTVMKGDIRDYNLLLAAMQGVHVVIHTAAIVDCRNMLPFWEMKAVNVGGTENVLRACCALNIPYVVYTSSIAAVGPNILHEPMLRGNEDTKYSGEVELPYGKTKAIAERLVLEANGKKLSNGGKLLTCVIRANTVYGEKAMFLHELYLSAKAHNGVLNYLEPEHTERNSTYVGNVAWMHVLAARHLQLKPDILAGQVYYSYDDTPTTKSFLIRYQLMSCMDPSIRLGSHIPYWKMWLLIHLHRIIEVILSPFWKLRPSLNFPLLHTIVTTFSYETDKAFRHFGYKPLYSWQESKLRTARWLEKAVGNPSLQ

SEQ ID NO: 618 - protein, 3530 aa, Homo sapiens [sequence omitted]

SEQ ID NO: 619 - protein, 487 aa, Homo sapiens
MRRGERRDAGGPRPESPVPAGRASLEEPPDGPSAGQATGPGEGRRSTESEVYDDGTNTFFWRAHTLTVLFILTCTLGYVTLLEETPQDTAYNTKRGIVASILVFLCFGVTQAKDGPFSRPHPAYWRFWLCVSVVYELFLIFILFQTVQDGRQFLKYVDPKLGVPLPERDYGGNCLIYDPDNETDPFHNIWDKLDGFVPAHFLGWYLKTLMIRDWWMCMIISVMFEFLEYSLEHQLPNFSECWWDHWIMDVLVCNGLGIYCGMKTLEWLSLKTYKWQGLWNIPTYKGKMKRIAFQFTPYSWVRFEWKPASSLRRWLAVCGIILVFLLAELNTFYLKFVLWMPPEHYLVLLRLVFFVNVGGVAMREIYDFMDDPKPHKKLGPQAWLVAAITATELLIVVKYDPHTLTLSLPFYISQCWTLGSVLALTWTVWRFFLRDITLRYKETRWQKWQNKDDQGSTVGNGDQHPLGLDEDLLGPGVAEGEGAPTPN

SEQ ID NO: 620 - protein, 893 aa, Gallus gallus
MGSNPLSPHVSLPLRYAAGTLLTPPPSPPSGTTEQGLTPSAVTPENHNNYGRHLLIPTMAARHRSVRRCSDLPTASEAFHPDGITTQRSLSNNPLRGCLQTPAAVKTFSELLPSSVEQFYHNTSLYNAASMFLRMPPRGAAPFRPAGAGRAEGRDPGRGAGTAAAFGMAQYARGAAAVAVIRLRNPPVNALSLTVLQALEDGLKRADADPSVKAVTICGENGKFSAGADIRGFSSPKKQGLGLGPIVSLIERSEKPVVAAIEGIALGGGLEVALGCHYRIAHVQARMGLPEVTIGLLPGAEGTQRLPRLVGVPAALDIITTGRHIPATEALKLGLVDEVVEENTVEAAIRLANKLIGQPLGHRRLSLKPVPRLPNMEAFLSEALVKVKKRAQGCLAPELCFQAIKAATEQPFADGVRKERELFNILLTSGQAKALQYAFFAERAVEKWTTPSGASWKSASPQPIRKAAVIGLGTMGRGIVTSLVKAKIPVVALEQNLEYLNTGRKAVMLLLEREAMKMEQGAQTLDFHNPAQLQFTVDFDVLRDVDLVIEAVFENMALKKEIFSKLSRICKPEAFLCTNTSALNIDDIASVTGRPQQVIGTHFFSPAHVMRLLEIIYGRHTSPNTIATAIQLAKVMKKVGVVVGNCFGFVGNRMMFPYVQQAVFLLEEGSRPEDVDQVLEDFGFKIGPFRMSDLAGLDVGWRSRKDQGLTGPSLAPGTPVRQRHGYRYSPLPDLLCEKGRFGQKTGKGWYQYEKAGGRTAKPDPWIHSFLREYRDTHQIKTRFIDQEEILERCLFTLINEGFDILAEGIASGPEHLDVVYINGYGWPKHRGGPMFYASIVGLPNILTKLQKYSEIHPDVPQLRPSAFLKKLVAVGNPPLNDWMSYLHRQSNKL

SEQ ID NO: 621 - protein, 1423 aa, Gallus gallus
MELKKTTSRVYNAALLLPLFLLFWGPSYSENDSSCSSSPCENGGSCKDLEAGYQCICPMHPIAYMGINCELLYDACTKHDCPAHMICNKTPGLPEYECICMPGFTGIDCSININECESNPCKDPRFECVDSVSGYACKCQTGLNGEGCQNSVCSSHLCLNNGTCVEGPGDYACICQPGFTGAHCKDNIDECASNPCQNGAICRDRVNEYSCFCVPGFQGYNCEIDINECASRPCKNNGTCLNEMDHYLCKCIPGYTGVNCEAEIDECDSYPCQNGALCSDHIGFYTCTCMPGYQGIQCEVDINECISQPCQHNGTCHDLINSYQCDCSDTGFEGDHCELDILECASEPCLNNATCVEGIKNYSCACWTGYTGQHCEEDVNECATDPCHNGGVCFERSNQSYYGSQPDFPSDFSYSQAAGFLCWCQPGFAGVECAVNINECEEGPCKNGAVCEDGIADYTCHCAPSQDGIVWGGKNCSVKLTGCQTHDCQNEALCIPTYQAESHGHLCQCQPGFYDATCSTPTTFSFASRGYLLIELPVNNQSRREVAGEQLASVSLRFRTTLPSAILFYRGHEAEYLFLELLDGILRTELKRQDEYLLLLEELRVDDGHWHKVEVVLQNTVQLKLWHDSCDAGVCMQSSPIPHNATPIPHAFLSVYIGGAQDPLANNTQSQQGFVGCLEDLQVDAEAVLPVALPVSEVSSVTQGCDRTEWCLSEPCFHGGLCVDLWTTFSLGADFNISFFIRSLKPNGLLLQISNETDPCLTIYLKNGKLKIEMLSTDTVTFPENLVDGRRHLVALSFQGGIVGVHQPDTYVELGQLVGRPLLAGYDVYIGGRPDPDSTDLWGGYFKGCLQDIQLNGHQIEFFQVENYSLPDELNRTQNINLVNGCISDNTCKSEPCQNGGRCIVTWNDFHCSCPANFTGKFCEERVWCESDPCPEATTCIDVPAGYVCLANATFNSSATIEFTTNTSVTRTLGSLLMDFRTRDEDAVLLRAMEEVDSLQIAIKNSSLLVDIRSGNSIEGVSFLSQNAVTDGAWHTISLSMEEPSALSSRWVAHLDGSINMTLQGNAGNLDFLKNNALIVLAENFTGCLGQVKIGGIYLPFTSHLSYPQPEQFQQSSRRTIQLGCTGADVCASSPCSNAGTCRDLFNSFSCACSAGWEGLLCESNTDDCQSSPCVHGNCTDRLADFQCECFRGYIGKKCDINVDDCVRHQCQNGATCIDGVYGYSCKCPAQYSGPRCEWPFPPEQCGKNFTCLNGGKCTTETWGANCTCKPGFTGRNCQININKCDPNPCQNGGTCQDSENKFKCLCSASYTGERCDINVQLELCRFVNQCWRYLQCQLPNTEVRPRTGEVQPLWAHLSNSSVVGAAGAAGTALLLAVGAATVIAMKRRRATQGRYSPSRQEKDGARVELWNVIKLPPTERLI

SEQ ID NO: 622 - protein, 454 aa, Mus musculus
MEDYLQDCRAALQDSRPLHVVLGNEACDLDSMVSALALAFYLTKTSEAEDIFIPVLNIKRSELPLRGDNVFFLQEVKIPEPALIFRDEIDLLALHQAGQLTLILVDHHILPKSDAALEEAVAEVLDHRPIEQKYCPPCHVSVELVGSCATLVTERILQGAPETLDRQTAALLHGTIILDCVNMDTNIGKATPKDSKYVEELEALFPDLPKRKDIFDSLQKAKFDVSGLTTEQMLRKDQKTVYRQGTKVAISAIYMDLKAFLQRTDLFTDLSSFCHDHSYDALVAMTIFFNTQNEPVRQLAIFCPHEALRMTICGILERSTSPPLKLTPIPSTSPNLQAYHQGNTQVSRKKLLPVLQEALSAYLDSAKMASGQSEVAVGMSREQVDKDLDKASNSLISGLSQDEEDPPLPPTPMNSLVDECPLDQGLPKFSAEAVFEKCSQISLSQSARACTSNK

SEQ ID NO: 623 - protein, 587 aa, Canis familiaris
MLLEWSLARGLVVINLLTVANIGLYCPCFQCGIIYWLFGGAVRNLGSPGHVTKWLQPLQEQKYTGMFAMTERGHGSNVRGIQTEATFDLSAQEFVIDTPCENAEKMYIGNAMYGNYAAVFAQLIINGRSQGPHCFIVPIRDEKGSLYPGVTAIDMMYKEGLHGVDNGILIFHKVRIPRENLLDKFGSVAPDGQYHSPIKNKSARFNAMLAALTPSRLAVTFQAMGAMKLGLTIAIRYSHSRRQFGPKAKEEVKIIEHQTQTLRLMPHLATALALTFVSRYAGILLDEDIFHGKELADSRPLQALVAGLKAYSTWENVRCLQDCRECTGGMGYMMENRISGLKCDTDVFVTFEGDNVVMLQVVVRELLAQYTKQHKEKPLFSCLQNWAESGSDKLRTSFLAFNVDIVDNLAFLLKAVNFRERVLQRSLVARIYHKVMTKKEDFFSAWNSCLHHVASLSLAHIHRVTLEQFSLAVRSCPDQEDQALLMKFCLLYATKLVFQERAWYLEHKYLTPMASTRIRSQLLDLCDSVKDDALRVISAFNIPDTSLHAPIAGITNAKAAWAFYPAPLQPEPGEGARSQRRKLEAKL

SEQ ID NO: 624 - protein, 953 aa, Canis familiaris
MEKQSHGEMGIIPSESHSHIKLLKINRELLVTHIRNTQCLVDNLLENDYFSSEDAEIVGACPTQPDKVRKILDLVQSKGEEASEFLLYVLQQLEDAYVDLRPWLSEIGFSPSELIQSKVVVNTDPVSRYTEKLRQQLGRDSKFVLCYAQKEELLLEETYTDTIAELVGLKDESLGPLGSLACLLDRSSGVLSEQGETIFICGDAGMGKSMLLQRLQSLWAARRLDAQFKFFFHFRCRVFSCFKEGDALCLQDLLFKHYCYPEQDPDEVFAFLLRCPHAALFTFDGLDELHSDFDLSGAPDTSSPWEPAHPLVLLANLLSGKLLKGAAKLLTARTGVEIPRQLLRKKVLLRGFAPSHLRAYARRMFPDRTVQQHLLAQLEANPNLCSLCAVPLFCWIIFRCFQHFHSVWDSAAQLPSRTVTLTDVFLLVTEVHLNRTQPTSLVQRNTRSQVETFRASRGTLRSLGQVAHGGMEKSLFVFGQEEVQAAEFQEGELQLGFLRAVPEPGVGGDQQSYEFFHITLQAFFTAFFLVVDDQVGTQQLLRFFQEWAPPGEAGAESCYPPLLPFQCLKGGGLAGEDPFKNKDHFRFTNLFLCGLLSKAKEKLLRHLVPPAALRRKRKALWAHLLASLRAHLKNLPRTQSGGFSQVQAMPTFIWMLRCIYETQSEKVGRLAAKGICANYLKLTYCNACSADCSALSFVLHHFRKRLALDLDNNNLNDYGVRELQPCFSRLTVLRLSVNQITDSGVKVLYEELTKYKILTFLGLYSNQITDVGARYVARILDECKGLTHLKLGENKITSEGGKCLALAVRNSSSILEIGMWGNRIGDEGAKAFAEALRNHPSLTNLSLAFNGISTEGGKSLAQALQRNTSLRIFWLTKNELDDEVAESLAEMLKVNQTLKHLWLIQNQITAKGIAQLADALQKNTGITEICLNGNLIKPEEAKVFEDEKRIVCF

SEQ ID NO: 625 - protein, 1328 aa, Homo sapiens
MSYAPFRDVRGPSMHRTQYVHSPYDRPGWNPRFCIISGNQLLMLDEDEIHPLLIRDRRSESSRNKLLRRTVSVPVEGRPHGEHEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSIDLQSFMARGLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDRVKEYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQERQLPPLGPTNPRVTLAPPWNGLAPPAPPPPPRLQITENGEFRNTADH

SEQ ID NO: 626 - protein, 1562 aa, Homo sapiens
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKAEVAGSKVVPALPESGQSEPGPPEVEGGTKATGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 627 - protein, 977 aa, Canis familiaris
MEEQDRGGSTWEAPQGKSRPDSPWSWIPMMRDPGWIRNVWPSNINTQTMNYVGQLAGQVFVTVKELYKGLNPATLSGCIDIIVVRQPNGSLQCSPFHVRFGKMGVLRSREKVVDIEINGESVDLHMKLGDNGEAFFVQETDNDQEVIPMYLATSPILSEGASRMECQLKRSPVDRIRSLDPNTSAQALPPSEAPSSGSLVKKRRKRRRKSQLDTLKRDDNTNTSEDEDMFPIEMSSDDQADPLDSSRNLPNDIPVFQEDVSKESPSPIMTYPQSASYPNSDREWSPSASSPIDCQRTAPHLAVAAEGGLSSSCPPQPSYFHASESPSGSRPSTPKSDSELVSKATDRTMQKNNLEMLWLWGELPQAAKSSPHKMKDCSPLNSRKICDKMHFQTIHSESSDAFSDQSPTLARPPVPSIPEPGRPSTEMQFVNEEDVEALGAAAPPLPTVEEPKPLSASVAPTASKTDSPSRKKDKRSRHLGADGVYLDDLTDMDPEVAALYFPKNGDPSGLPKHASDNGARSANQSPQSVGSSGIDSGVESTSDGLRDLPSIAISLCGGLSDNREITKDAFLEQAVSYQQFVDNPALIDDPNLVVKIGNKYYNWTTAAPLLLAMQAFQKPLPKATVESIVRDKMPRKGGRWWFSWRGRNTTIKEESKPEQCLAGKSHSTGEQPSQLSMATRIKHESSSSDEEHAAAKPSSASHLPLLSNVSYRKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDVHSASA

SEQ ID NO: 628 - protein, 2948 aa, Homo sapiens [sequence omitted]

SEQ ID NO: 629 - protein, 2638 aa, Bos taurus
MGSGGTQTSAESALEAPGAPQKSDSPSSSDGRGSDKPPSQPQSPEGSSGARTQGETEDSGTDPDSSQEGAGPCRSPGAAPGTTRGAPEASEADPNRKAAASSPLEGSPACIPRSSWGSQDPRQGGDARDDGVQPEAEPRGAPPERAEVSTARGQRRQIGKVMGKAHEAVGVSNEGSGGDGPRAPAPLAALVALRRLRVAESPAHDPSEDEDPTPDPKFAVVFPRSSEEGSADAPAGEGRDWSCAGASADSAGRRASVEGVAESPRGSLGPNPHEEPPVDESGSSSEAEPETLGAAAPVHWAEGSDPHKDPRLGTEALLPRLTLETRLLPEGSPGPRGSLRDRWEPEDEVEEALERDLELSLVPGPEEPPFPSGADGWTVGEGLEDTEDLARLRPVCDSSVLLCLKKRFHLGRIYTFGGPLLLALNPRRALPLYAPEVLASYRPGKTPNTTPHIFAVVASAYSLSESTGQATCILLGGHSGSGKTEAAKKMVQFLHSLEWEQRERGCRESGLQASGFSSEAAPGMAYCGAGWAGETDPSVGRQSPHLDTVLPLLSSFGHAKTVLNANASRFGQWALGLVYPGHPHRVLCPQWGRRRCFCVTSPARDLEGGVSGHKTRLPLPLSQSFSPEAQAERSFHVFYELLAGLDPVEREQLSLQGPETYYYLNQGRACRLQDKDDAQDFTGLVRALQALGLCTEELTAVWAVLASVLQLGNICFSSSEREFQEVAAVSSWAEIHAAARLLQVPPERLEGAVTRRVTETPYGQVSRSLPVESAIDARDTLAKALYARLFTWLLRMANAQLASPVEAGSTVTITVIDVYGFEVTLRLPWPPHLMWVPTSLLTCPQALRVNGLEQLYNNLGSERLQLWCNRLLLAQEEAPQESCLDFLVDQPHSLLSILDAQTWLSQGREAQPRQGSHTCRGLSISSFHQATDHTFLQKCHYHHGDHPRYTKPQLPLPIFTVRHYAGPVTYQVHKFLNRNRDRLDPAVVEMLAQSQLQLVSCLFQEAEPDEFGGGRGKPTLAARFQKSLGDLLAQLGRSHVCFIQCLNPNPGKLPGLFDVDHVAEQLRQAGILEAVCTRSANFPIRLPFQAFLDRFRALGTEEQGELSDRERCGIILNQVLAAESPLCHLGATQVLLREPGWQQLEQCWAQQHAQALLTLHRGLRVCISHQRLHLLLRMQARVRGLQTRKRYLRRRAALEQLNTIVLAARPLLWRRRRPQLGRRHIWHSVGAFETVPSMELGRLEIPAELSVMLKTAEGRQHARVQSITEAMPPEVPARPSLTLPPDINQFPFSSFISIGFQEPSLPHPGQLLTKPLTRLDGENPQHALDINKVMLRLLGDGSLAPWQEQTMGQYLVRQGQRQPGLRDELFSQLVAQLWRNPDEQQSQRGWALMAILLSAFPPMHTLQKPLLKFVSDQAPRGMAALCQHKLLGALEQMQLAPGSARAHPPTQLEWTAGWRRGRMALDVSTFNEECYSAEVESWTTGEQFAGWILQSRGLDPPPRGWSVSLHCRDSWRDLAGCDFVLDLIGQTEDPGDPAWHHSYPIAPRGLAENIPLAPSIQAPSLPPGPPPGPAPTLPSRGLTGESRTSGSLDGFLDHLFKPVLSPGLSDLEQGRALSGRMKGGGAMGPMQQGSYPMVYPGMVQMPSYQPAMMPAPMPMMPAMGPVPGKTGLWPPAMVVPPQPQPVLPSLDVRQLAAQQQDFINQQARILAQQMTTQAMTLSLEQQAKQLQKQTPTAASLTSPPPAITHEPKTPTPQKEPESGLELVGARLRQEAPQEAEDRHPRPRSFQQKRDYFQKLGQQPSKVKTMKPPAKVKIPQAEVQDEEPEEEEQRAGGPSAPPPQVVKKPPLSQGAARAAQEAEAEPATEVGPGGGHRKPPQSFLKKNNPKDEALAKLGISGASSPPQTLPSPGKAPPPAVAPRPRARPRLMPSSSIKEKQGPLQELFGQNPPTAQKPPPPPAPPLPPPWEPASPPAEPRSLVEPMGDQGVSTQLLVPSGSVCFSYASAPWRLFLRKEVFYPRESFSHPYCLRLLCEQILYCLSHQGSPFLTHNEGSKTKSMLGLFPPAGDLEVGLDSLDTAEDGVKKRIVVAARNNWANYFSRIFPVSGESGSDVQLLAVSHRGLRLLKMTQGPSLHPDQLKTLCSYSFAEVLGVECPASSTLELSLKSEQLVLHTARAGAIKAMVELFLSELKKDSGYVIALRSYITDDHSLLSFQRGDLIKLLPVATLEPGWQFGSTGGRSGLFPADIVQPAAAPDSFFSTEQRSSQGHKGQLQRREWDRASEQDCELPVGRGEAVRLSCGPRGTYSPPTPWSQARSDNSATSLSPSVAYVALPTDSDYTMQEFALRYFRKPQTLPAQTGGDAEKATASLVQYSKVKGTVQGSQARRPARWPCPASPRPTAQPLWLQAPIQESLISFSDEDTNRQAVESFQALMQFMGDQSKPRGKNELDLLYGLLKLCQEKEDLRDEVYCQAIKQVTGHPRPKLCARGWRFLSLLTGCVPPSNTLMPYVTKFLQDWGPHQELAQSSQEHLQRTVKYGGRRRLPSPGEMQAFLVLGVRAGQRSRTPCGWQELGPLSMGGLTLRLPWQKGQVVHLVLIHLPGGVDYKTNIRTFTVSAGPQPGAGGAGETREAWEPPHP

SEQ ID NO: 630 - protein, 1120 aa, Homo sapiens
MVLNSLDKMIQLQKNTANIRNICVLAHVDHGKTTLADCLISSNGIISSRLAGKLRYMDSREDEQIRGITMKSSAISLHYATGNEEYLINLIDSPGHVDFSSEVSTAVRICDGCIIVVDAVEGVCPQTQAVLRQAWLENIRPVLVINKIDRLIVELKFTPQEAYSHLKNILEQINALTGTLFTSKVLEERAERETESQVNPNSEQGEQVYDWSTGLEDTDDSHLYFSPEQGNVVFTSAIDGWGFGIEHFARIYSQKIGIKKEVLMKTLWGDYYINMKAKKIMKGDQAKGKKPLFVQLILENIWSLYDAVLKKDKDKIDKIVTSLGLKIGAREARHSDPKVQINAICSQWLPISHAVLAMVCQKLPSPLDITAERVERLMCTGSQTFDSFPPETQALKAAFMKCGSEDTAPVIIFVSKMFAVDAKALPQNKPRPLTQEEIAQRRERARQRHAEKLAAAQGQAPLEPTQDGSAIETCPKGEEPRGDEQQVESMTPKPVLQEENNQESFIAFARVFSGVARRGKKIFVLGPKYSPLEFLRRVPLGFSAPPDGLPQVPHMAYCALENLYLLMGRELEYLEEVPPGNVLGIGGLQDFVLKSATLCSLPSCPPFIPLNFEATPIVRVAVEPKHPSEMPQLVKGMKLLNQADPCVQILIQETGEHVLVTAGEVHLQRCLDDLKERFAKIHISVSEPIIPFRETITKPPKVDMVNEEIGKQQKVAVIHQMKEDQSKIPEGIQVDSDGLITITTPNKLATLSVRAMPLPEEVTQILEENSDLIRSMEQLTSSLNEGENTHMIHQKTQEKIWEFKGKLEQHLTGRRWRNIVDQIWSFGPRKCGPNILVNKSEDFQNSVWTGPADKASKEASRYRDLGNSIVSGFQLATLSGPMCEEPLMGVCFVLEKWDLSKFEEQGASDLAKEGQEENETCSGGNENQELQDGCSEAFEKRTSQKGESPLTDCYGPFSGQLIATMKEACRYALQVKPQRLMAAMYTCDIMATGDVLGRVYAVLSKREGRVLQEEMKEGTDMFIIKAVLPVAESFGFADEIRKRTSGLASPQLVFSHWEIIPSDPFWVPTTEEEYLHFGEKADSENQARKYMNAVRKRKGLYVEEKIVEHAEKQRTLSKNK

SEQ ID NO: 631 - protein, 540 aa, Oryctolagus cuniculus
MLHKYLKLICLLAAICVLCIISQNSTKIWGALKLPNSHYYSNTSMISSIPKMSVSPVKSLTETELRVKEILEKLDRLIPPRPFTHVNTTTSATHSTATILNPQDKYCVGDQLDILLEVRDYLGHQKEYGGDFLRARMFSPALKAGASGKVTDFNNGTYLVSFTLFWEGQVSLSVLLIHPSEGASALWRARNQGYDRIIFKGQFVNGTSHVFTECSLTLNSNTEECKYLNGRDQDVFYCMKPQHMPCEALTHVTSRNRDISYLTSKEKNLFHRSKVGVEIMKNQHIDVSQCNKSKEVKEKCQIGMKIPVPGGYTLQGRWLTTFCNQIQLDTAKISGCLKGKLIYLMGDSTLRQWIYYLPKVMKTLKFFDLHETGNFKKHLLLDAEKHTQIQWKKHSHPFVTYQLFSVIDHGYIPQEIDRLIGDKDTVIVITFGQHFRPFPIDIFIRRAISVRQAIERLFLRSPATKVIVKTENIREMHIEAERFGDFHGYIQYLTLKDIFKDLNVGVVDAWDMTIAYGTNNVHPPDQVIGNQINMFLNYIC

SEQ ID NO: 632 - protein, 1490 aa, Canis familiaris
MAQGMVLGGTTRQGPVGTPLAMAQGMTASLQRWASAPQGASVPAPRCRAHWLGPSSATPSDLSDACAGARRRRRFSTSARTAAPPTGMDAGSGSSSGGPAPGPAPGPGPEGEQRPKGEPLASDGSSPDRSQSKAVASEASPEKSCCPHSGPLEDPSSSSEPPPATSTLQPVRPTSPLAPAHFTYPRAPQEYRGDSSLPGLGDRAALCSHGSSLSPSPAPSQRDGAWKPPSVQHHVVSVRQERAFRMPKSYSQLIAEWPVAVLLLCLAVIILCTLAGLLGDRLPDFSKPLLGFEPRDTDVGRKLVVWRALQTLTGPRKLLSLSPDLEQNSSNLHTTLSPTPWSSAQEGLIRPRRMVEPLEDRGQDSFFCGPPEKSYAQLVFMSTSAGSLWNLHAIHSMCRMEQDQIRSHTHFGALCQRTEANKCCPSWSLGNYVAVLSNRSSCLDTTQADAARTLALLRACATYYHRGALVPSCLGPGQDKPPHCVQVPTKCSRNSAIYQLLHFLLDRDFLSPQTADYQVPSLKYSLLFLPTPKGASMMGIYLDRLATPWGLSDNYTSITGMDLGLKQELLRHYLAQDTVYPLLALAAIFLSIALYLRSLFLTLMVLLGVLGSLLVAFFLYRVAFRMAYFPFVNLAAFVLLSSVCANHTLIFFDLWRLSKSQLPSGGLAQRVGRTMHHFGYLLLVSGLTTAAAFYASYLSRLPAVRCFALYMGTAVLAHLALTLAWLPASAVLHERYLARGCASRAQGQRGGSAPRRLALALQRRLRGLRRAAASTSRLLFQRLLPCGVIKFRYIWICWFAALAAGGAYIAGVSPRLRLPTLPPPRGQVFRPSHPFERFDAEYRQQFLFERLPQGEGGHMPVVLVWGILPVDTGDPLDPRSNSSLVSDPAFSASGPEAQRWLLALCHAARNQSFFGAQPEGWPTLCFMEALQRWVESPGCARLGPGLCCGHSGFPWAPQLFLHCLKMMALEQGPNNTRDLGPRFDTHGSLAALVLQFQTNFQYSPDYSQTHHFYTEVSHWLAAELGRAPPGLHRGWFTSHLELYSLQHSLSTEPAVVLGLALALAFATLLLGTWNVPLSLFSVAAVAGTVLLTVGLLVLLEWQLNTAEALFLSASVGLSVDFTVNYCISYHLCPHPDRLSRVAFSLRQTSCATAVGAAALFAAGVLMLPATVLLYRKLGIVIMMVKCVSCGFASFFFQSLCCFFGPEKNCGQILWPCAHLPWDAGTGEPSGEKAGRPRSGPVGGAPGSCSEQYELQPLARRRSPSFDTSTATSKLSHRPSVLSEDLQLHDGPCCPRPPLAPASPRELFLDHQAVFSQCPALQTSSPYKQAGPSPKTQGRKDSPMQKAEPVQASPEASTHSPKPKAVEPPDCLCSSASTLEGLSVSDETCLSTSEPSARVPDSVGASPDDLDETEQTVPERGQLNGKRDTLWLALRETVYDPSLPASHQSSSSWKGRGAPGDGSPVVLPNSQPDLPDVWLRRPSTHTSGYSS

SEQ ID NO: 633 - protein, 2190 aa, Macaca mulatta
MKEIVLAVGHSPCQEKPQKKGREGEAEAAAAVCKNRRGEGRCHPQPSELIAAGTARSGVSQQLDERLPRSWGGGSQREQERKHVPTLPTPLGPGGLGHQLGLLGPTLYAEVGDTIKVHFKNKADKPLSIHPQGIRYSKLSEGASYLDHTFPVEKMDDAVAPGREYTYEWSISEDSGPTHDDPPCLTHIYYSHENLIEDFNSGLIGPLLICKKGILTEDGKQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNPKKITREQRRHMKRWEYFIAAEEVIWDYAPVIPANMDKKYRSQHLDNFSNQIGKLYKKVMYTQYEDESFTKRTVNPNMKEDGILGPIIRAQVRDTLKIVFKNMASRPYSIYPHGVTFSPYEDEVNSTFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCITDDDEDSYEIFEPPESTVIATRKMHDPLETEDEESDTDYDYQSRLAAALGIRSFRNSSLNQEEEEYNLTALVLENGTEFISSNTDIIVGSNYSSPNNISKLTVNNFAEPQKTPSHRQATTAGSPLRHLTGKNSVLNSSTAEHSSPYSEDSIEDPLQPDVTGIHLLSLGAREFKNQEHAKRKGPKVERDQAAKHRFSRMKLLAHKVGRHLSRDTGSRSRVRPWEDLPSDLLLLKQNNSSKILVGRWHLASEKGSYEIIQDTDEDTAVNNRLISPQNASRAWGESTPLANKPGKQSGHPRFPRVRHKSLQVRQDGGKSGLKKSQFLIKTRKKKKEKRTHHAPLSPRTFHPLRTEAYNTFSERRLNHSLLLHKSNETSLPKDLNQTLPSMDFSWIASLPDHNQNSSNDTRQTSSLPDLYQTVPPEEHYETFPIQDPDEMHSTSDPSHRSSAPELREMLEYDRSHKSFPTDISQMSPSSEREVWQTVPSADLSQVTLSPQLSQTNFSPDLSHTTLSPELSQTNLSPALGQMPMSPDLSHTTLSPDLSHTTLSPDLSHTTLSPDLSPTTLSPDLSHTTLSPDLSHTTLSPDLSPTTLSPDLSHTILSPDLSPTTLSPDLSHTNLSPDLSHTTLSPDLSQTNLSPALGQMPMSPDLSHTTLSPDLSHTNLSPDLSHTTLSPDLSQTNLSPALGQMPMSPDLSHTTLSPDLSHTNLSPDLSHTTLSPDLSQTNLSPELSHTNLSPALGQMPLSPDLSQVTVSPDISETTLLPDLSQISPPPDLDQTFYPSESSQLLHLPEFNETFPYPDLGQMPSPSSPTLNDTFLSKEFNPLVIVGLSKDGTDYIEIIPKEEVQSSEDDYAEIDYVPYDDPYKTDVRTNINSSRNPDNIAAWYLLRSNNGNRRNYYIAAEEISWDYSEFVHRETDIEDSDDIPEDTVYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEVKKSHEFHAINGMIYSLPGLRMYEQEWVRLHLLNIGGSQDIHVVHFHGQTLLENGNKQHQLGVWALLPGSFKTLEMKASKPGWWLLNTEVGENQRAGMQTPFLIMDRDCKMPMGLSTGIISDSQIKASEFLGYWEPRLARLNNGGSYNAWSVEKLAAELASKPWIQVDMQKEVVITGIQTQGAKHYLKSCYTTEFYVAYSSNQINWQIFKGNSTRNVMYFNGNSDASTIKENQFDPPIVARYIRISPTRAYNRPTLRLELQGCEANNNKQWLEIDLLKIKKITAITTQGCKSLSSEMYVKSYTIHYSDQGVEWKPYRLKSSMVDKIFEGNTNTKGHVKNFFNPPIISRFIRVIPKTWNQSIALRLELFGCDVY

SEQ ID NO: 634 - protein, 1075 aa, Pan troglodytes
MDWTWRILFLVAAATSAHSQVQLVQSGAEVKKPGASVKVSCKASGYTFTSYDINWVRQATGQGLEWMGWMNPNSGNTGYAQKFQGRVTMTRDTSISTAYMELSSLRSEDTAVYYCARDTPWTPRHFHLVISTEHRGLTMELGLSWVFLVAILEGVQCEVQLVESGGGLVQPGGSLTLSCAASGFTFSSYWMSWVRQAPGKGLQWVSVISGSGSTIYYADSVKGRFTISRDNTKNSLYLQMNRLRAEDAAAYYSVRDTGPADITPQHPVLFLSTTEWALQLLLLSVCSALRLTSALMMKFKSLMCLQFSDNPLASCHWVLSQVTLKESGPTLVKPTQTLTLTCTFSGFSLSTSGVGVGWIRQPPGKALEWLALIYSDNDKRYSPSLKSRLTITKDTSKNQVVLTMTNMDPVDTATYYSVVHWWSWVRQPPGKGLEWIGEIYHSGSPNYNPSLKSRVTISVDKSKNQFSLKLSSVTAADTAVYYCARGTSITQQPHPSSEAPRAQLLTMDWTWTILVLVAAATGKGLPNPSEEEGIEASQGGFHPLLCLLHRCPLPGPAGCSLGLKVKKPGASVKVSLQGFWIHLPLAMLCNWVRQAPGQRLEWMGWINTGNGNTKYSQKFQGRVTITRDTSASTAYMELSSLRSEDTAVYYCARDTGALRTLGSTQNRQGALRTPGGAQNRQGALRTLGSTQNRQGALRTPGGAQNRQGALRTLGGAQNRQRALRTLGGAQNHQGVLRKPEDAQESPGGAQKTPGGAQDTRGHSELPGGAQKKQGVLRTPEGAQKHQGALRTPTGTHETVARGGCSGTTRGRSQHQRAVRTTGACSEPPGGAQDTRGAQEPPGDAQDTSRVSEPPGDAQDTKGRSVNQRVPRKPGEVQEPPGGTEDTKGCSEPPGGAQEPQGDTQDTRNQGRFRNHQGALRTPRGAQNHQGALRNHKGTLRTLVGTEEPPGGAQDTRGRSENQGVLRTSGGTQNTKGIQDTRGCSEQPGGIQIHQGPLRTSRGRSDPPEGAQNHQWVFRTARMAQDTRGHSGPPRGSLEAVPYQVPGEDEVSFSTLVIPDLVKQKSSPGSLTMSSL

SEQ ID NO: 635 - protein, 422 aa, Bos taurus
MLQWRRRHCCFAKMSWNAKRSLFRTHLIGVLSLVFLFAMFLFFNHHDWLPGRAGFKENPVTYTFRGFRSTKSETNHSSLRNIWKETVPQTLRPQTATDPNNTDLSLQGVTGLENTLGANGSIYNEKGTGHPNAYHFKYIINEPEKCQEKSPFLILLIAAEPGQIEARRAIRQTWGNESLAPGIQITRIFLLGVSIKSSGYLQRAILEESRQYHDIIQQEYLDTYYNLTIKTLMGMNWVATYCPRIPYVMKTDSDMFVNTEYLIHKLLKPDLPPRHNYFTGYLMRGYAPNRNKDSKWYMPPDLYPSERYPVFCSGTGYVFSGDLAEKIFKVSLSIRRLHLEDVYVGICLAKLRIDPVPPPNEFVFNHWRVSYSSCKYSHLITSHQFQPSELIKYWNHLQQNKHNACANAAKEKAGRYRHRKLH

SEQ ID NO: 636 - protein, 353 aa, Homo sapiens
MSKPPDLLLRLLRGAPRQRVCTLFIIGFKFTFFVSIVIYWHVVGEPKEKGQLYNLPAEIPCPTLTPPTPPSHGPTPGNIFFLETSDRTNPNFLFMCSVESAARTHPESHVLVLMKGLPGGNASLPRHLGISLLSCFPNVQMLPLDLRELFRDTPLADWYAAVQGRWEPYLLPVLSDASRIALMWKFGGIYLDTDFIVLKNLRNLTNVLGTQSRYVLNGAFLAFERRHEFMALCMRDFVDHYNGWIWGHQGPQLLTRVFKKWCSIRSLAESRACRGVTTLPPEAFYPIPWQDWKKYFEDINPEELPRLLSATYAVHVWNKKSQGTRFEATSRALLAQLHARYCPTTHEAMKMYL

SEQ ID NO: 637 - protein, 715 aa, Canis familiaris
MGRLELVVLGLTCYWALASAAKLGAVYTEGGFVEGVNKKLGLFGDYVDIFKGIPFAAPPKALENPQRHPGWQGTLKAKDFKRRCLQATITQDNTYGEEDCLYLNIWVPQGKKEVSRNLPVMIWIYGGAFLMGAGHGANFLSNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALCPWVIQRNPLFWAKRIAEKVGCPLDDTARMAKCLKVTDPRALTLAYKMPLAGMDLLLSHSDPMLHYLGFIPVVDGDFIPDDPINLYANTADIDYIVGTNNMDGHIFASIDMPAINKNKQEVTDEDFYKLISGLTMIKGLRGANSTFDVYTKPWARDATQETKKKTVVDFETDILFLVPTETALAQHRANAKSAKTYTYLFSHPSRMPIYPKWVGADHADDIQYVFGKPFATPLGYRPQDRTVSKAMIAYWTNFARTGDPNMGHSAVPIHWDPYTVESGNYLEITKKMDHNSLKQHLRTDYLRYWAVTYEALPTVTGDEATPAPPSGDSNATPAPPSGDSNAPPAPPSGDSNAPPAPPSGDSNAPPAPPSGDSNAPPAPPSGDSNAPPAPPSGDSNAPPAPPSGDSNAPPAPPSGDSNAPPAPPSGDSNAPPAPPSGDSNAPPVPPSGDSNAPPAPPSEDSEGAQMPIVIGF

SEQ ID NO: 638 - protein, 742 aa, Danio rerio
MWFSWMLLLATLASSSASSRTREWAHHGAMMFADLTPQEMYAVRDYLYSCSELGLTSARGTSLKKNSILLMELHVPRKHEALRALDKGQAKPSRQARVVVQFGNQAVPNVTEYIVGPLPFPKTYHLKTFKNNKNIRFESRPISAVEYEHLSGVLDKVGSKVNKILQESTGFTYGNCTKRCLTFSDIAPRGLTSGERRTWIMLQKFVEGYFIHPVGFEVLVNHKDLDHEKWTVEKVWYNGQYFDSLDEFVEKYEKGTVDKIKLPEHDEEDLFSTYIPRGDMNTRTNIHGAKLVEPQGRRFQVDGNFVEYAGWSFAYRVRSSAGLQIFDLRYNGERIAYEIALQEAIAFYSGDTPAAMQTKYIDAGWAMGTSDYELSPGIDCPEIAHFVDLYHYYDTDKPVRYRNALCIFEMTTGIPLRRHFNSNFQGGYNFYGGLENHVLVIRTTSTVYNYDYIWDFVFYQNGVMESRVSATGYIHATFFTENGLNYGTRVYNYVLGNLHTHLIHYKVDLDISGRENSFESIDLKYVNFTNPWSPGHTIMQSKLHRTQYETERSAAFRFGKKFPKYLHFYNPNQLNKWGHKKGYRIQYNSHANSVLPRGWREENGIPWSRYPLAVTRHKDSEVTSSSIYTQNDPWEPLVSFEEFVRNNENIVNQDLVAWVTVGFLHIPHSEDVPNTATPGNSVGFFLRPFNFFNEDPSLASRSTVIVRPDEKGQPKVQRWTPEVVGHCVSDKPFFYNGTYAGV

SEQ ID NO: 639 - protein, 776 aa, Equus caballus
MAEAHQAVAFQFTVTPDGIDLRLSHEALKQICLSGLHSWKKKFIRFKNGVITGVYPASPSSWLIVVVGVMSTMYAKIDPSLGIIAKINRTLDTTGYMSSQTKNIVSGVLFGTGLWVALIITMRYSLKVLLSYHGWMFAEHGKMSRATRIWMCMVKIFSGRKPMLYSFQTSLPRLPVPAVKDTVNRYLESVRPLMKDEDFKRMTALAQDFAVNLGPRLQWYLKLKSWWATNYVSDWWEEYVYLRGRGPLMVNSNYYAMDLLYVIPTHLQAATAGNGIHAILLYRHKLDREEIKPILFLGSTVPLCSAQWERMFNTCRIPGEETDTIQHLRDSKHIVVFHKGRYFKVWLYHDGRLLKPREIEQHIQRILDDPSEPHAGEAKLAALTAGERVPWAKCRQAYFGRGKNKQSLDAVEKAAFFVTLDETEQGYREEDPDASMDSYAKSLLHGRCSDRWFDKSFTFIVFKNGKMGMNAEHSWADAPVVGHLWEYVMSTDCFQLGYAEDGHCKGDTNPNIPYPTRLQWDIPEECQDVIETSLNTANILASDVDFHSFPFHAFGKGLIKKCRTSPDAFVQLALQLAHYKDMGKFCLTYEASMTRLFREGRTETVRSCSSESCNFVLAMVDPTQTVKQKLRLFKIASEKHQHLYRLAMTGSGIDRHLFCLYVVSKYLAVDSPFLKEVLSEPWRLSTSQTPQQQVELFDLERNPEYVSSGGGFGPVADDGYGVSYILVGENLINFHISSKFSSPETDSHRFGKHLKQAMNDIMALFGFSSNSRKEFH

SEQ ID NO: 640 - protein, 1458 aa, Homo sapiens
MGLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVDHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 641 - protein, 1188 aa, Danio rerio
MADSLEERSLEVLDIPDDLDDDFLVLYFENKRRSGGGRVVSLERRGNQALVVFEDAETAVSVSSKSHSLHNTTLTLRRKPPKDPGKLLLRGLNPDTPMDYVELFVENITRLDLETEFTLYPSPNKDLVLIHLKKRPSKDFQTLSDDVSKKSLHGAKVSLEQVVATDSILVSNLSTQTEDVLELYFGSIRSGGADVVAVSMLSDGRAKVSFKDVKTVDRVLQKSHNLEDRDLVVEPYFDFLHAVVGQASAASQDGQSTLMDGMNLTEPVSSQSPTVSHPMDSTSLGQANAQTNIIPVIPNLTPATAAEPLIQKECVSFVSVPDAAKHNLLRLSKLTEDLTKAHPQFDVSLAKDGVQIKGPDQIEVERLKNKVLEFLTGVVQDHQTYDKLKADFLGREDVKKRLDSSLKDFPSIYSVSDCTVTVTSSSRNTARQTHDLLKSRISEFTVPVANEYKSAIFSEEWSDFLTSLDFCSTTVSEDAGRINVVTLAGMEKDNKGKIVEFLSTPHQKETVLSMQPGMLKFLQLHHQDLLADMGEVILFPLESGDGLSMGMGRYKILTIQGDANVCQSAAELLSAIIGSVFTRSIVVKHPGISRFLLDDEGTSILAEMTAKFEVYIDMTKVHWEPLEDKDILELAWKMTPCQNFQKSSSANSIQEFTAGVPNGATDAHASARIEEAKKILAVIGSDFNPAPSSSGSTNTDTQDIYSDPSEEIIEVNSDSDDQPQPLQTLDLPSFSAPTNVCNLDEDASLLLAIQLSMEINQRKDNDDIQKALELSKRDSVPREENKQLEMAFEMSMEEAIRLSNTAEIFVYANYNHDLVRVDIALGKKVGLRQCEEKIENKILRKLSSFQKRCIDLIKRKHAVEINIQGTTAILSGFKEYVSVAVPDLKDVLRRTEHMMSDAGIAKSVQWVWYEQGSSKGTPYSPEATVFIENAWKLKQKKIDILFNNQPYSIDLEKMEEHSLASGKSVPIKRKMMSTEDLYTDGADEDYSLLSSMPEVSTVDVNSDEFQDVVKEFYDTLQDNHNKIRIIKVEKLMNKLLHDQYRLKKASIEQSTSEPQFERTLYHGTSETSVKEICIHGFNRSFCGKNATVYGQGVYFAVNASLSVSDTYSPPNADGHKFIFVAKVLTGEFTVGKHEMKAAPLKENSAVPFRYHSVTDQINSPTLFVIFNDTQAYPKYLITCKKIYG

SEQ ID NO: 642 - protein, 423 aa, Pan troglodytes [sequence omitted]

SEQ ID NO: 643 - protein, 430 aa, Xiphophorus hellerii
MEPVITRTLILLVLVTISTAAPLQDAAVEDGGTSPAAPDRCGGVEFDAIAPNEKGNTLFFKGDHVWNGFTGPAQLSSLHFKELSGPINAAFRMHNTENPNDHDHIYLFQDDKVYSYFNQTLEEGYPKQIQEDFPGVPTHLDAAVECPKGECMADSVLFFKGQDVHVYDIATKAVKTKTWSHLPSCTSAFRWLEHYYCFHGQNFTRFHPVSGEVTGAYPKDARHYFMNCPNFGHGGDRKPLKCSNIKLNAATTDDGGRTYFFAGPIYIRVDTHRDGFHAFPITRAWKEANDGVDAVFSYDSKMYLIKGDQVYIYKADAHFTLIEGYPKTVKEELGIEGTVDAAFVCPTENIAHIIQGNSMRDVDLTATPRVISREFPLPLSDIDAGLCGDDGIRLFKGSQFYYYESPRILAMGRIAPVASDITSALMGCED

SEQ ID NO: 644 - protein, 115 aa, Xenopus laevis
MVSHSCLLPILMLWLQGSYGQIVMTQSPDYVSVSPGETVTITCKASSSVGSNLNWYQQKSGQAPKLLIYAASTRHTGTPERISGSGSGTDFTLTISRMEAEDAADYYCQQSRSLP

SEQ ID NO: 645 - protein, 226 aa, Acidovorax sp. JS42
MLGRVDYPATVAAMQRFTEERTDETPDELWICEHPAVYTQGLAGKSDHVLSPGSIPVVATNRGGQVTHHGPGQVVAYPLIDLRRAGYYVKEYVYRIEEAVIRTLGHYGVTGHRVAGAPGIYVRLDDPHGHSMLPQRPQKRAHADGPPQPDFTGLGKIAALGIKVARHCTYHGVALNVAMDLEPFSRINPCGYAGLQTVDLSTIGVHIPWDDAAAMLGQQLARRLAP

SEQ ID NO: 646 - protein, 789 aa, Aedes aegypti
MVKFLIDHNANIDTANNGGRTPLHVASQNGHLKVVKLLIDNGANVDTEGDEGWTPLHLAAENGYLEVVKLLIDNGANVDTTQDEGWTPLHLAAENGHLEVVKLLIDNRANVDTKKNGGWTPLHVASQNGHLEVVKLLIENRANVDTKKNEGWTPLHFASQNGHLEVVKFLIDNRANVDTTQDEGWTPLHVASQNGHLEVVKLLIENRANVDTKKNEGWTPLHFASQNGHLEVVKFLIDNRANVDTTQDEGWTPLHLAAENGHLEVVKLLIENRANVDTKKNGGWTPLHVASQNGHLEVVKFLIDNRANVDTTQYEGWTPLHVASQNGHLEVVKLLIDNKANVDTTQNKGITPLHFASQNGHLEVVKLLIDNRANVVKLLIENRANVDTTQNKGITPLHFASQNGHLEVVKLLIENRANVGTTQNEGWTPLHFASRNGHLEVVKLLIENRANVDTTQNEGWTPLYVASINGHLEVVKLLINNRANVDTTQNEGWTPLYVASKNGHLEVVKLLIDNKANVDTTQNEGWTPLHVASQNGHLEVVKLLIDNRANVDTTKNKGITPLYVASKNGHLEVVKLLIDNKANVDTTDNEGWTPLHVASQNGHLEVVKLLIENRANVDTTQNKGITPLHFASQNGHLEVVKLLIDNRANVDTTQNEGWTPLHVASQNGHLEVVKLLIENRANVDTTQNKGITPLHFASQNGHLEVVKLLIDNRANVDTTQNEGWTPLHVASQNGHLEVVKLLIDNRANVDTTQNKGITPLYVASINGHLEVVKLLIDNRANVDTTQNEG

SEQ ID NO: 647 - protein, 324 aa, Acidovorax sp. JS42
MTPPALPPPVPEDVIQAALRLQGPAHRTPVLRSGTADRLLHAHLFFKCENLQRAGSFKFRGAFNTLSQFTPEQRRHGVLAFSAGNHAQAIALAARLLDMPALIVMPEDAPASKMAATREYGAQVVTYNRYTEDREAISQRIAQERGMTLVGPSEHPHVIAGQGTAALELFEEVPRLDYLFVGVGGGGLMAGSLLAAQARAPQCQVVGVEPEAANDAQQSLRSGHIVRIATPRTIADGAQAQSLGPLVFDIVRRQGHDITTTSDLHLMQAMRFFAERMKIVVEPTGALAFAGAQHGGVDIRGKRVGIVISGGNVDLARYARFLAD

SEQ ID NO: 648 - protein, 171 aa, Homo sapiens
MSSGNAKIGHPAPNFKATAVMPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGILRQITVNDLPVGRSVDETLRLVQAFQFTDKHGE

SEQ ID NO: 649 - protein, 458 aa, Acidovorax sp. JS42
MKASKGRNVVVVGTQWGDEGKGKLVDWLTESAQGVVRFQGGHNAGHTLVINGVKTALHLIPSGIMRPGVKCYIGNGVVLSAGKLFEEIEGLEKAGVEVRSRLRVSEACPLILPFHAALDVAREAAREHGGAEKIGTTGRGIGPAYEDKIARRALRVQDLKYPERFAAKLRELLALHNHVLSTFLGSANFQFGDALKPYITGGQVQFEPVFEEAMRHAEMLKPMMADVSRELNEAHAAGANLLFEGAQGTLLDVDHGTYPYVTSSNCVAGNAAAGSGVGPGHLHYILGITKAYCTRVGGGPFPTELDWETPGTPGYHMSTVGAEKGVTTGRSRRCGWFDAALLKRSAQVNGLSGLCITKLDVLDGLRELSLCVGYELDGERIDLLPMGAEEIARCVPIYENIAGWTESTVGVTHYENLPSNARRYLERIEQVTGVPIAMISTSPDRDHTILMRHPYAAD

SEQ ID NO: 650 - protein, 808 aa, Canis familiaris
MPVGSAAAKRQERRRERGRAAGRGERRRPTRSNMAPVGGGGLPGGGPARGRLLLAALLLPVLMWARGARGQGDPQRGAILGMRLASCNKTCGMNPDGIIFVSEGSTVNLRLYGQRLGSISSNLISFTEVDNSEAVHNSTNCPELTKDLVVQQLVNLSRGNTSGMLVVLTKFLRRSENMKLYALCTRAGVDGPWQRWTDKDSLLFMVEEGGRVLPLWLHILLIMVLLVLSGIFSGLNLGLMALDPMELRIVQNCGTQKERRYARKIEPIRRKGNYLLCSLLLGNVLVNTSLTILLDNLIGSGLMAVASSTIGIVIFGEIVPQALCSRHGLAVGANTIILTKFFMLLTFPLSFPISKLLDFVLGQEIRTVYNREKLMEMLKVTEPYNDLVKEELNMIQGALELRTKTVEDIMTQLQDCFMIRSDAILDFNTMSEIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTDNRSRKRVSEKNKRDFSAFKDADNELKVKISPQLLLAAHRFLATEVPQFSPSLISEKILLRLLKYPDVIQELKFDEHNKYYIRHYLYTRNKPADYFILILQGKVEVEAGKENMKFETGAFSYYGTMALSSPTTDHSPSHPTTLSRSASLSYPDRTELSSTATLAGSSNQFGSSILGQYISDFSVRALMDLQYIKITRQQYQNGLLASRMENCPQFPLDGCTICTDNLAGKSELPVVDETTTLLNERNSLLHKASHESAI

SEQ ID NO: 651 - protein, 330 aa, Rattus norvegicus
MELLSTPHSIEINNITCDSFRISWAMEDSDLERVTHYFIDLNKKENKNSNKFKHRDVPTKLVAKAVPLPMTVRGHWFLSPRTEYSVAVQTAVKQSDGEYLVSGWSETVEFCTGDYAKEHLAQLQEKAEQIAGRMLRFSVFYRNHHKEYFQHARTHCGNVLQPYLKDNSGSHGSPTSGMLHGVFFSCNTEFNTGQPPQDSPYGRWRFQIPAQRLFNPSTNLYFADFYCMYTAYHYAILVLAPKGSLGDRFCRDRLPLLDIACNKFLTCSVEDGELIFRHAQDLILEIIYTEPVDLSLGTLGEISGHQLMSLSTADAKKDPSCKTCNISVGR

SEQ ID NO: 652 - protein, 297 aa, Bos taurus
SDQALSFLKDFLAGGVAAAISKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGAAQREFTGLGNCITKIFKSDGLRGLYQGFNVSVQGIIIYRAAYFGVYDTAKGMLPDPKNVHIIVSWMIAQTVTAVAGLVSYPFDTVRRRMMMQSGRKGADIMYTGTVDCWRKIAKDEGPKAFFKGAWSNVLRGMGGAFVLVLYDEIKKFV

SEQ ID NO: 653 - protein, 1225 aa, Gallus gallus
MSFRVGGLNFCRRRSLTAPSVRKEKCPGAAAAACGEPRRDGLRAALGDAVYAAFPERKRTRTPTNADGRRTVADKIQYRVVDGRLQYNMSAECGDPSRLPWLSGAAAQQHCVTFLGSFSDLPFPGEEDKGLCSKLALLIHIGDASRGCRSIMSCLCAADFDPDIKLLEMQGSLINGDENLACQIYESNPQLKETLDPNTSYGETYQHNTPLHYAARHGMNRILGTFLFVRDGNPNKRNVHNETSMHLLCMGPQIMISEGALHPRLTRPSEDDCRRADCLQMILKWKGAKLDEGQYERAAIDAVDNKKNTPLHYAAASGMKTCVELLVKHGGDLFAENENKDTPCDCAEKQHHKELALNLESRMVFSRDPEAESIEAEYAALDKKEPYEGLRLQDLRRLKDMLIVETADMLQAPLFTAEALLRAHDWDREKLLEAWMSNPENCCQRSGVQMPTPPPSGYNAWDTLPSPRTPRTTRSSVTSPDEISPSPGDIETAVCDICMCNISVFEDPVDMPCGHDFCRACWEAFLNLKIQEGEAHNIFCPAYDCFQLVPVDIIESVVSKEMDKRYLQFDIKAFVENNPAIKWCPIPGCERAVRLTRQGSNSTGSDTLSFPMLKAPAVDCGKGHLFCWECLGEAHEPCDCQTWKDWLQKISEMKPEELVGVSEAYEDAANCLWLLTNSKPCANCKSPIQKNEGCNHMQCAKCKYDFCWICLEEWKKHSSSTGGYYRCTRYEVIQHVEEQSKEMTVEAEKKHRRFQELDRFMHYYTRFKNHELSYQLEQRLLKTAKEKMEQLSKALSGTEGGCPDTTFIEDAVQELLKTRRILKCSYPYGFFLEPKSTKKEIFELMQTDLEMVTEDLAQKVNRPYLRTPRHKIIRAACLVQQKRQEFLASVARGVAPADSPEAPRRSFAGGTWDWEYLGFASPEEYAEFQYRRRHRQRRRGDMHSLLSNTPDPDDPSESTLDTQEGGSSRRHGTSMALSSLDEDDPNILLAIQLSLQESGLAIDEETRDFLNNEASLGAIGTSLPTRLDSAPISIDNPRAALSSSELLELGDSLMRLGAGSDPFSADRLHSHTCSDTRGGLYSTSSDADSSSQDPNTNENLLGNIMAWFHDMNPQSIALIPSTSTEADEDSQQPSTEDGSAGQANVRDTGLELQEEHALFEDALKNEGRGTQTEEGTSEENIIPGETVSQGGDNSREVTGTLDASGDASNQTPQTSSEWIERVHLV

SEQ ID NO: 654 - protein, 604 aa, Rattus norvegicus
MAGDVEGFCSSIHDTSVSAGFRALYEEGLLLDVTLVIEDHQFQAHKALLATQSDYFRIMFTADMRERDQDKIHLKGLTATGFSHVLQFMYYGTIELSMNTVHEILQAAMYVQLIEVVKFCCSFLLAKICLENCAEIMRLLDDFGVNIEGVREKLDAFLLDNFVPLMSRPDFLSYLSFEKLMSYLDNDHLSRFPEIELYEAVQSWLRHDRRRWRHTDTIIQNIRFCLMTPSSVFEKVKTSEFYRYSRQLRYEVDQALNYFQNVHQQPLLDMKSSRIRSAKPQTTVFRGMIGHSMVNSKILLLKKPRVWWELEGPQVPLRPDCLAIVNNFVFLLGGEELGPDGEFHASSKVFRYDPRQNSWLRMADMSVPRSEFAVGVIGKFIYAVAGRTRDETFYSTERYDITNDKWEFVDPYPVNKYGHEGTVLNNKLFITGGITSSSTSKQVCVFDPSKEGTIEQRTRRTQVVTNCWENKSKMNYARCFHKMISYNGKLYVFGGVCVILRASFESQGCPSTEVYNPDTDQWTILASMPIGRSGHGVTVLDKQIMVLGGLCYNGHYSDSILTFDPDENKWKEDEYPRMPCKLDGLQVCNLHFPDYVLDEVRRCN

SEQ ID NO: 655 - protein, 608 aa, Xenopus tropicalis
MASLINRCPFATRDPTVFLRVARPFLLRSAERCPVMVTCTLSTSPGCEQRTKDTTPVTGVSTGASNRRTLAQAAPQAAISNATCPFIENEIGKSEGIIVQRAGPQVQEDISAFKTDALSSLLIEVQSSLKKKFLAPPKKVNLGTGAPLIPTHLIKENMTGRAAFGYDDFFSRRIEEKKSDHTYRLFKTVNRRADAYPFAEDYSDLHGEKKEVSVWCSNDYLGMSRHPKVLKAIAEALEEHGAGAGGTRNISGTSKYHVDLECELADLHNKDAALLFSSCFVANDSTLFTLAKMLPGCEIYSDAGNHASMIQGIRNSGVTKFVFRHNDPAHLEELLQKANPKTPKIVAFETVHSMDGAICPLEEVCDIAHKYGALTFVDEVHAVGLYGTHGAGVGERDSVMHKMDIISGTLGKAFGCVGGYVASTASLIDTVRSYAAGFIFTTSLPPMVLAGAVESVRVLKSEEGQALRRAHQRNVKHMRQLLMDAGLPVINCPSHIIPIRVGNAAINTRICDVLLSQYNIYVQAINYPTVPRGEELLRLAPSPHHTPDMMNYFVESLVSAWKEVGMPLHTPSAAECNFCHRPLHFDLMSEWERTYFGNMEPKYITMYA

SEQ ID NO: 656 - protein, 991 aa, Canis familiaris
MEVGSGVRPGSFKSKSGHKGDGKNSAPVQLKVRPRGPPCHGGSHLGLSNRTAFSSINRNLVELSEQMQKDVTSSSLLGTFRDSGFFCSGFSKFRFSLLLLNLEEYYFEQHTANHIQNKGGQNERKIRGSLKICSKSVIFEPDAISQPIIKIPLRDCIKIGKHGENGSNRHFAKTKSGEISLIFSQVYFIKEHNIVAPYKIERGKMEYVFELDVSGKVEDVVETLLQLHRASCLDKLGDQTAMITAILQSRLARTSFDKNRFQSVSEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAERTAESYTLQWQRGHLSNYQYLLHLNNLADRSCNDLSQYPVFPWIISDYCSAELDLSNPGTFRDLSRPVGALNKERLERLLARYQEMPEPKFMYGSHYSSPGYVLFYLVRIAPEYMLCLQNGRFDNADRMFNSIGETWKNCLDGATDFKELIPEFYGDDVSFLVNNLKLDLGKRQGGQMVDDVELPPWARSPEDFLQKSKDALESNYVSEHLHEWIDLIFGYKQKGSDAVGAHNVFHPLTYEGGVDLNSIEDPDEKVAMLTQILEFGQTPKQLFVTPHPRRITPKFKNFSQTYSHNAPMADSPGEESFEDLTEESKTLAWNNIAKLQLHDQYKIHKEAVTGIAVSCNGSSVFTTSQDSTLKMFSKESKMLQRSISFSNMALSSCLLLPGDATVISSSWDNNIYFYSIAFARRQDTLMGHDDAVSKICWHDNRLYSASWDSTVKVWSGVPAEMTCTRRQRFDMLAELEHDVSVDTISLNAASTLLVSGTKEGTVNIWDLTTATMLHQIPCHSGTVCDAAFSPDSRHVLSTGEDGCLNVIDVQTGMLISSMTSDEPQRCFIWDGNSVLSGSQSGELLVWDLLGGKISERIQGHTGAVTCIWMNEQCSSIITGGEDRQIMFWKLQY

SEQ ID NO: 657 - protein, 779 aa, Xenopus laevis
MNTTAPPPENGQYSTNQPRPYFYAQPTAQLPFQNPWYLGQLYNPYCIPGPGFRGGNPYFPYYSVALHEYPGYFVPQPQMNTRMSRRPHFNPHPPSPMFYHATRFRHYSSPGRRTETKETQTDPRQQECASKKQHSSDGKGCDGGNVVYLSSGISSTGNESNLENVEMSMSPATSTQERDFHKNACNSAQYRNMPPGSYAYEKEEVRIEYGSGSPAAIQMWKSYKETIPIYDVAVVKELPENVVQRDLFCEGVLYGPHAEGEELAVQSVAFSNKDECKNSLPPKLCIDAVQETETQTTIVQTREPRYETSKQGKQVMKVKATMEAESPTMVTEHVEVVSPVYDDPQVSVPEDSDEHNLITNGDLIEGSDGCPEQQDIANQSTCNGEVKLANKSNMWTDDSIEKFMPSPTWLACFENIDANYDYDVYSSQRKQKQTSVLSITSEELSSRDEGSSLDSASVSYFVPDYILRKGLYTFRKTTEDLEKETIKSSGSLKEDDIPLKQSCNKYVKKYRSSAVKAKDVSSRCRKIGVPLKGLSRRKLYSVKKNPKKSQSLSEPEDSDEYWVMEEENNEEGDDEDDSEEEEYYFQESLPHGQVDIGKGSIFKQIAQKRILWKPPKGMVPAQIVGWPVKEKLVTKKGAYDALNQVCRLKDYDGSDYTIYDKKISKLNRGFISEPKKSMQKSVGGKAQKKTPGTAVEEYWVGRGAKPKFPEPAYYLQDPTKIKEQDKPPKKKGALKSSKRKQTRTDPEEVETWEVPRSFLYRGHGLQKRGTKKKQLNGKL

SEQ ID NO: 658 - protein, 597 aa, Xenopus tropicalis
MAMRGLVEAECGGSNPLMKLTNHFTQDKALREEGLQHVSWPPGATVVSKPLGEATEDELVSEFLHTRVPSLQSRAPHTFKMDGLLAEMQEIEQSSFRPEPLRAPGVADLALSEQWSAEFVGAEVDPVEEEDWSREFTEQADPMSSPSHWAEEYLQQSEEKLWLGESEGALAEKWTEEYQPEDELQREAKTLLSQVTDPKLANSQFLQFVKRIGDGELSFSHAPSTPSQAVSQAEQWSEQFVQEQAEQWVDQFAPLEKDFEKAKAAVESDVDFWDKLQEEWEEMAKRDAEAHPWLSDFQDLSSKSIDKGYMFEENNPFSEASHPFEEGLKHLREGDLPSAVRLFEVAVQRDPHHMEAWQYLGTTQAENEQELAAISALRRCIELKPDNLSALMALAVSYTNECLQQQACHTLREWLRHNPKYSHLVKEESVNNASRARSFGTLLSDSVFAEVRELFLSAVRSDPSQVDPDVQCGLGVLFNLSGEYQKAVDCFTAALGQKPDDYLLWNKLGATLANGNDSEAAVEAYRRALQLQPGFIRSRYNLGIACINLGAHREAIEHFLEALSMQQQSGGSESAMSDNIWSTLRMALSMSDVIPTQ

SEQ ID NO: 659 - protein, 1041 aa, Xenopus laevis
MAQAGDEWELSKENVQPLRQGRVMSTLQEVLSQQESASHTAVQQQKQAFELELRFYAGDDPLDVWDRYIKWAEQAFPQGGKESNLCPLLERGVKIFHEEQRYYDDLRYLNICLKFANFCSEPLDLYSYLHSQGIGVSHSLLYITWAEQFEARGNFKKADSMFQQGMQCKAEPLEKLEIHHRQFQARVSRQVLQGISEGPDVEEPELSEPQRSSLADLKSRGKTKAKVPVNRVGDSIKSRPQGLGLQAAPPQQIPNRSRFSVFDENAAMSAAQELPSLTPQQWTAPPPARSKENEQRARPWNSGRPSRNGHQAPVSELPQSLPSFTPYVDEGAQHQTVTPCKINPAVTSVLSSRKPGKDEDPLQRVQNNSQGKEETVMYCKDKVYAGVEEFSLEEIRAEIYMAKVRRKREDDLQASALRRQDMERQIEEMERQLKGSCIGSKETVIEQPAHNVEPIITPCNSKTSESICAPQQEPGMEFPLCFEMADAAPTLPRMGILPVSDVLGNNHNSSGLSPALSCDMPFTIFDESSEALPSMSVPKTIAAPVRRPLAVVSKTKSESQLTDTLDGIEHLNEEAIVCGSGKNKSLFPDPEDTCDFVRAAHLASTPFHRARDESEESLQRNSAERLPLQEKTPVCEESYRQELCIKKLSPILEASQEDTRTSVSSVSSISSTTSMFTSKTLPLSEKLELATQITGVYESEPTTEELPQAEEIAELHRQLLELLPELLVSPEIQHEVGTMPDLKEQEELVLGCETYSLKNEVILHPNSKLFMGAPVDWDMEEMKAFALKVDYQPVPWDLYVTLQLKERLGDLFETFFMEQTNCFLYQNGCISLYKDINRFSIQEILLDSEELIKEVIVLVTYNLLSLVEKLHSVEIVHGDLRPETLLLDDKIFDLSSSLELEGLFKMVDFSHSMDLKLCPTMSSLRGFPIAQSESGQQFLNPQSSPYQVDILGIADLVHLMIFRKPLQLNQENSVWTICKEVPRLRGGNLWNQFFTKILNAEGPSTCVLRELKGEMMELFDSGFQDKLCNYFIQLEMRLNPL

SEQ ID NO: 660 - protein, 403 aa, Homo sapiens
NMAETSEEVAVLVQRVVKDITNAFRRNPHIDEIGLIPCPEARYNRSPIVLVENKLGVESWCVKFLLPYVHNKLLLYRTRKQWLNRDELIDVTCTLLLLNPDFTTAWNVRKELILSGTLNPIKDLHLGKLALTKFPKSPETWIHRRWVLQQLIQETSLPSFVTKGNLGTIPTERAQRLIQEEMEVCGEAAGRYPSNYNAWSHRIWVLQHLAKLDVKILLDELSSTKHWASMHVSDHSGFHYRQFLLKSLISQTVIDSSVMEQNPLRSEPALVPPKDEEAAVSTEEPRINLPHLLEEEVEFSTDLIDSYPGHETLWCHRRHIFYLQHHLNAGSQLSQAMEVDGLNDSSKQGYSQETKRLKRTPVPDSLGLEMEHRFIDQVLSTCRNVEQARFASAYRKWLVTLSQ

SEQ ID NO: 661 - protein, 684 aa, Macaca mulatta
MMDASKELKVLLVDFLKQENAVSHHTWEFQTSNPVFRRGQVFHLRLVLNQPLQSYHELKLEFSTGPKPSIAKHTLVVLDPRTPSDHHNWQATLQNESGKEVTVAVTSTPNAILGKYQLHVKTGKHILKSEENILYLLCNPWCKEDTVFMPDEDERKEYILNDTGCHYVGAARSIKYKPWNFGQFEKNVLDCCISLLTESSLKPTDRRDPVLVCRAMSAMIHFEKGQGVLVGNWTGDYQDGTAPYKWTGSAPILQQYYSTKQAVRFGQCWVFAGILTTVLRALGIPARSVTAFDSAHDTEKNLTVDTYVNENGEKITNMSRDSVWNFHVWTDAWMKRPDLPKGYDGWQAVDATPQERSQGVFCCGPSPLTAIRKGDIFIVYDTRFVFSEVNGDRLIWLVKMVNGQEELHVISMETTSIGKNISTKAVGQDRRRDITYEYKYPEGSPEERQVMDHAFLLLSSEREHRRPVKENFLHMSVQSDDALLGNPVNFTVILKRKTAALQNVNISGSFELQLYTGKKVAKLCDLNKTSQIQGQVSEVTLTLDSKTYINSLAILDDEPVIRGFIIAEIVESKEIMASEVFVSFQYPEFSVELPNTGRVGQLLVCNCIFRNTLAIPLTDVKFSLESLGISSLQTSEHGTVQPGETIQSQIKCIPIKTGPKKFIIKLSSKQVKEINAQKIVLITK

SEQ ID NO: 662 - protein, 311 aa, Morone saxatilis
MRHSVVFLLLLLLGACSAYNYKNVALRGKATQSARYLHTHGAAYNAIDGNRNSDFEAGSCTHTIEQTNPWWRVDLLEPYIVTSITITNRGDCCPERLNGVEIHIGNSIQENGVANPRVGVISHIPAGISHTISFTERVEGRYVTVLLPGTNKVLTLCEVEVHGYRAPTGENLALRGKATQSSLFESGIAYNAIDGNQANNWEMASCTHTKNTMNPWWRMDLSKTHRVFSVKVTNRDSFEKRINGAEIRIGDSLDNNGNNNPRCAVITSIPAGASTEFQCNGMDGRYVNIVIPGREEYLTLCEVEVYGSVLD

SEQ ID NO: 663 - protein, 376 aa, Magnetococcus sp. MC-1
MAKPDAGKDRAYMDHALRLAARGLGRTRPNPTVGCVIVKEDRIIGRGWHRKAGGPHAEVEALRMAGEAARGATAYVTLEPCSHHGRTPPCCEGLIKAGIRRVVAAMEDPNPLVSGQGFQRLKQAGVVVQVGVREEAAQMLIRPFITRILHNRPMVTLKSAASLDGKTATRERHSQWITGEAARKRGHRLRDTHDVILTGIQTVLADDPRLTCRLKGGRDPIRVVVDSSLKLSENAGVINPDSTAPVWVATTLRAPEEKRALFALLPGVEVIMCAEDDTGRVDLYDLMEKLAKREITSVLAEAGGVLSGALLDKRLVDRIALFMAPMLIGGREASGILDSLGAAKLTEAPRLDHVTLTSLDGDLLVEGCVVYGATEG

SEQ ID NO: 664 - protein, 594 aa, Homo sapiens
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSGGYSQRLPNASALGKIFTALPLGNPIYQMLELKLAMYIDFPLNMNPGILVTCADDIELYSIGEFEFIRFDKPGFTALAHPSSLTIGTTHGVFVLDPFDDLKHRDLEYRSCHRFLHKPSIEKMYQFNAVCRPGNFCQQDFAGGDIADLKLDSDYVYTDSLFYMDHKSAKMLLAFYEKIGTLSCEIDAYGDFLQALGPGATVEYTRNTSNVIKEESELVEMRQRIFHLLKGTSLNVVVLNNSKFYHIGTTEEYLFYFTSDNSLKSELGLQSITFSIFPDIPECSGKTSCIIQSILDSRCSVAPGSVVEYSRLGPDVSVGENCIISGSYILTKAALPAHSFVCSLSLKMNRCLKYATMAFGVQDNLKKSVKTLSDIKLLQFFGVCFLSCLDVWNLKVTEELFSGNKTCLSLWTARIFPVCSSLSDSVITSLKMLNAVKNKSAFSLNSYKLLSIEEMLIYKDVEDMITYREQIFLEISLKSSLM

SEQ ID NO: 665 - protein, 1220 aa, Macaca mulatta
MPGLLNWITGAALPLTASDVTSCVSGYALGLTASLTYGNLEAQPFQGLFVYPLDECTTVIGFEAVIADRVVTVQIKDKAKLESGHFDASHVRSPTVTGNILQEGVSIAPHSCTPGKVTLDEDLERMLFVANLGTIAPMENVAIFISTSSELPTLPSGAVRVLLPAVCAPTVPQFCTKSTGTSNQQAQGKDRHCFGAWASGSWNKLCLVTLLNTDVSNPMEYEFNFQLEIRGPCLLAGVESPTHEIRADAAPSARSAKSIIITLANKHTFDRPVEILIHPSEPHMPHVLIEKGDMTLGEFDQYLKGRTDFIKGMKKNNSAERKTEIIRKRLHKDIPHHSVIMLNFCPDLQSVQPCLRKAHGEFIFLIDRSSSMSGISMHRVKDAMLVALKSLMPACLFNIIGFGSTFKSLFPSSQTYSEESLAMACDDIQRMRADMGGTNILSPLKWIFRQPVHRGHPRLLFLITDGAVNNTGKVLELLRNHAFSTRCYSFGIGPNVCHRLVKGLASVSKGSAEFLMEGERLQPKMVKSLKKAMAPVLSDVTVEWIFPETTEVLVSPINASSLFPGERLVGYGIVCDASLHISNPRSDKRRRYSMLHSQESSSSVFYHSQDDGPGQEGGDCAKNSGAPFLLGQAKDARLVSRNSTTKHDPNISQRRRAYSTNQITNHKPYPRATTASDPMPAAKRYPLRKARLQDLTNQTSLDVQWWQIDLQPLLNSGQDLDQSPKLRGPGARRPSLLPQGCQPFLPWGQETQAWSPVRERTSDSRSPGDLEPSHHPSAFETETSSDWEAPAESQERASPSRPATPGPVLGKALVKGLRDSQRLQWEVSFELGPPGPERRGERDADLWSETFHHLAARAIIRDFEQLAEREGEIEQGSNRRYQVSALHTSKACNVISKYTAFVPVDVSKSRYLPTMVEYPNSAALRMLSSRALAQQWRGTSSGFGRPQTMLGEDSAAGHGKFQALNMEASPTAPFSETTSPGREKHGASEGPLRSLATNTLSSMKASENLFGSRLNLNKSRLLTRAAKGFLSKPLIKAMESTSGNQSFDYVPLVSLQRASGAFLLNQAFCEATHIPMEKLKWTSPFTCHRVSLTARPSESKTPSPQLCTSSPSRHLSCDSFSLEPLTKGKLDLEPKAVMEHTGKLWATVVGLAWLEHSSASYFTEWELVAAKANSWLEQQEVPEGRTQGTLKAAARQLFVLLRHWDENLKFNMLCYNPNYV

SEQ ID NO: 666 - protein, 367 aa, Ralstonia solanacearum
MKVGLVGWRGMVGSVLMQRMQEEKDFDLIDTVFFSTSNAGGKAPSFAKTDAPLADANDIDALKQCDTIITCQGGDYTTEIFPKLRAAGWNGYWIDAASTLRMEDDAVIVLDPVNLQLIKDAVARGTKNFIGGNCTNSILLMGVGGLFRDGLVEWVSSMTYQAASGGGANHMRELLKGMGVIHREVEEELASPASAILEIDRKVAKTIREDVPTEYFPAPLAGGLIPWIDKQLDNGQSKEEWKGQAEVNKILGTARTIPVDGLCVRIGAMRCHSLGLTLKLKRDLPLEEIESIIRSGNPWVKWVPNERGITEQELTPAAITGGLDIGVGRVRKLNMGPEYVSAFVIGDQLLWGAAEPLRRMLRILLGK

SEQ ID NO: 667 - protein, 521 aa, Roseiflexus sp. RS-1
MTVETVERTTLPLTGEEYLESLRDGREIWIYGERVKDITTHPAFRNATRMVARLYDALHDPEKQAVLTCPTDTGNGGFTHKFFRASRSAEELVGARDAIAEWARLTYGWMGRSPDYKAAFLATLGANAEFYTPYQENARRWYRESQERVLYFNHAIVNPPIDRNRSPDEVRDVYMHVERETDAGLIVSGAKVVATGSALTHYNFIAHYGPLPIKSKEFALIFIVPMDAPGVKLIARPSYEMAAEVMGSPFDYPLSSRLDENDSVMVFDQVLIPWENVFVYGDVEKVNAFFPLSGFIPRFTFHGCTRMAVKLDFIAGLFLKAIDATGAKDFRGVQARVGEVLAWRNLFWAISDAMARTPIPWNEGAVLPNLDYGLAYRVFATVAYPRIKELIENDVASALIYLNSHAVDFKTPEIRGYLDKYLRGSNGYSSLDRVKLMKLLWDAIGSEFGGRHELYERNYAGNHENIRLEVLLTAMATGAADRYKGFADQCLNEYDLDGWTVPDLINPDDVNIVMQRFGARQ

SEQ ID NO: 668 - protein, 287 aa, Bradyrhizobium japonicum USDA 110
MPQPAPMITKDGRLAYEAAGDPGAIPLIFLHGIGGAARAWRHQLATFGDRFRAIAWDMPGYGGSAPLARVSIAALADALQQFIEQLGATRPILVGHSIGGMIVQKWLEQSPKLARAVVLAQTSPAFGKADGDWQKSFIAARLGPLDRGETMRSLAPSLVKELVGDNPDAEGMELARACMGSVPEASYRAMMLALIGFDQRSTLKDISVPTLLLSGSKDNNAPAPMMAKTATYIPSAQYVELAGVGHLANLERPEAFDEALGKFLDSVVAKHRCLRNDHASQQDDRRE

SEQ ID NO: 669 - protein, 387 aa, Xenopus tropicalis
MEPEHTSPESKGSNWDINDMKLPQDPEQTDWFQEWPDSYVKHIYSSSNRNAQRHLSGWAMRNTNNHNSRILKKSCLGVLVCSNDCTVPDGRKVYLRPAICDKARQKQQSKHCPNCSGPLKLISCRGHGGFPVTNFWRHEGPYIYFQTKGVHDHPKPETKLESESRKVGHKKRNAIVTTKLGLKRSRNDEALTGEKADQENLSNTPLDQDTQAMLYDLKDMEMDNSETENILNNCLNSYNFEKDLNQLENISDLEWSKNLSRDNQNESNQCIGGELSSTMEFDFYSEDQQMWNKVFIAKNQHMQPLENLCWEKSPLQSCHGLYNQQISNVEPSIIDGLLNFKSNADDVHEGMLHVNHNNSASSSAVYRLCQEDSYLFRYNPNHFSPIL

SEQ ID NO: 670 - protein, 387 aa, Xenopus tropicalis
MDSVKAPPRALPPMPSTIIDEIPLSRSKKKKSKSNNVPDDLLQNAGFNTSENKDPLSPERRKKKKKRLSIDAETSLTQHNPALPVVQNGKDTDNQAAEEGTTRKPRRRTKKTRSVGQEFPNELGVEDEDIIPDGHTKIPEQNPAFLASSLTSQPVGKFFVEKNRRFQAADRSEIIKTTEQTDVFLDVKPTWTSMDVSLTAHHIFRMVGLFCCGFLAGYAVWNIVVVYVLAGSQLTNLPNLLQTYKILAYPSQCFLYFLLVLSTITAFDRIDLERTADALRGLLKLDPAALASFFYFVALILALSQQMTSDRINFYTPPTENGSLWQANTEEQILQPWIVINLVVALLVGLAWLFLSCRPDIDHTEEAMFIPEGEDYPDMEKGTKIQG

SEQ ID NO: 671 - protein, 829 aa, Xenopus tropicalis
MAASTGADKHSVKDIFLSMEYGPAPEAANIAQAWLDSHQRSFGHFIDGKWLKPEGRNTYTTKNPATGEALASTVQGEEEDVETAVKAARKAFESWSKLPCHVRARYLYSIARTVQKHQRLLSVIESMDNGKPIREARDCDVPLVVRHFYHHAGWAQLRDTEMNGWKPLGVIAAIVPWNFPLMLLTWKICPALAMGNTVVLKPATYTRLTALLLAEICAEAGLPPGVFNVVTGNGAFGGKLADHPDVDKVAFTGSTEVGRTLRKATAGTGKKLSLELGGKSPFIVFDTSDLDSAVEGIVDAIWFNQGQVCSAGSRLLMQESIAEDLIRRLKQRMSHLRLGDSLDKAIDVGALVDETQKKTIEEFVEEAQAEGADVFQSPGPIPKKGLFYPPTLITGVNTTSRCVREEIFGPVLVAMTFRTAKEAIALGNNTPYGLAASVWTENLPLALEVAISIKAGTVWVNGHNMFDAAAGFGGYKESGFGRDGGKEGLYEYVRPSWESRPQPSPGEVNYKTFAASYGADLPPIPGQKDIQPSVIRLQDSQIPSVDRTYKLYYAGAQKRPDGMYSRPICGPDGTVAAYVSDSNRKDVRNAVEAAHKAAPGWGKRAAHNRAQIVYYMAENLELRRDEVAQRLSTLTGLSKEKALQEVDLSIQRLFYWGAYCDKYGGTVQETLLYGATVMIREPVGVVGITCPDEYPLLSFVSLFAPAIVRGNAVVMIPSEKFPLPALDFYQVFDTSDLPGGVVNLLTGGRDHLAKYLVEHQDVQAMWYFGSEQGSKFVEWSSAENCKRTWVNYGHARDWEDAQQGAGEEFLYQATQCKNIWIPMGEIFAN

SEQ ID NO: 672 - protein, 526 aa, Xenopus tropicalis
MEYKMRTGTHKDCKMKLLFFLVVIKLCSGQYDPNVKPGKTSIVHLFEWKWEDIADECERYLGPNGFGGVQISPPNENLVITKPWRPWDERYQPVSYQLCTRSGNEEQFIDMVTRCNNAGVHIYVDTVINHMTGYGAGIGNSSTCGSYFNSGARDFPAVPYSFLDFSNYKCKSHSGGIENYNDPYQVRDCQLLGLLDLALEKDYVREKIAEYMNNLINIGVAGFRLDASKHMWPGDIKAILNRLEDLNTTWFSNGTRPFVYQEVIDLGGEAISASDYFGTGRVTEFKYGAKLGTVIRRWNGEKMAYLRNWGEGWGFMPSDRALVFVDNHDNQRGHGAGGSSILTFFESQLYKMAVGFMLAHPYGFTRVMSSYRWPRHFADGKDINNWMGPPSNPDGSTQPVTIKADTTCGNNWVCEHRWRQIKNMVIFRNVVDGQALTNWWDNGNNQIAFGRGNKGFIVFNNDDWDLDVTLNTGLPAGTYCDVISGQKQDTMCSGKKITVNKDSTAHFQISNTAEDPFVAIHVNAKL

SEQ ID NO: 673 - protein, 810 aa, Bos taurus
MSENSSDSDSSCGWTVINHEGSDIEMVNSEHGAASDSCEPAPECASLSQEELQELQVEQGESSQNGTVLLGGAAYPALEEMKSALEGEEEKLPDDNLYFGTVSDDSDIVTLEPPKLEDIGNQEEALIVKEAESPEDFNMGSSSSSQYTFCQPETVFSSQPSDDESSSDETSHQPSATFRRRRARKKTVSSSESEERLLAEQEPEPPQELCKRQFSSGLNKCVILALVIAISMGFGHFYGTIQIQKRQQLVKKIHEDELNDMKDYLSQCQQEQESLIEYKSLKENLARCWTHTEAEKMSFETQKKNLDTENQYLRTSLEKEEKALSSLQEELRKLREQIRILEDKGTSAELVTENQKLKQHLEEEKLKTHSFLNQRETLLAEAKMLRKELERERLITMALRVELQQLSSSHSYGNPDSPSVVTEKKEIEMLRERLTELERKLTFEQQRSDLWERLYVEAKDQNEKQETDGKKKGNRGNHRAKNKSKETFLGSVKETFDAMKNSTKEFVRHHKEKIKQAKEAVKENLKKFSDSVKSTFRHFKDTTKNIFDEKGNKRFGATKETAAKKPTTFSEYFHPQYKARTQNQNSRGPTMQREGRKEKPHFEEFGKNTNSQKCSAEHDCGGNYNSFRKACSGVFECAQQESINLFNVKMLNPVRIDEFRQLIEGYLLEKLDSFHHWKELDHFINKFFLNGVFIHDQKLFTDFVNDVKDYLKDMKEYQVDNDGVFEKLDGYIYRHFFGHTFSPPYGPSRPDKKQRMVNIESSRHRKQEQKHPQPQPYKREGKWHKYGRTNGRHMANLEIELGQLPFDPKY

SEQ ID NO: 674 - protein, 1618 aa, Homo sapiens
GRGRRRRRNGRGAEPPPPKAPSLRPRTGAVAWRSKVPPSPQGRRAQARGLFGGSAPGLHLEAAPDGDGQRLLPSGSRAGRCEGTMALTPGWGSSAGPVRPELWLLLWAAAWRLGASACPALCTCTGTTVDCHGTGLQAIPKNIPRNTERLELNGNNITRIHKNDFAGLKQLRVLQLMENQIGVVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQAGALAEPCRGLQCLHGHCQASGTKGAHCVCDPGFSGELCEQESECRGDPVRDFHQVQRGYAICQTTRPLSWVECRGSCPGQGCCQGLRLKRRKFTFECSDGTSFAEEVEKPTKCGCALCA

SEQ ID NO: 675 - protein, 722 aa, Xenopus laevis
MEPAVYVIPDNNLEQPPVYDVVSNTQVQPAPLPYNTQVHSNQFVAASPISPFQWSFRKKVLISIGTVSIVAAVIVASVLTGYFVSTTQSVPYCQKRCSYSSKCIYGYQICDGVQDCPYGDDERNCATTCLYCSYSYTCIYYYQICNGVQDCPYGDDERNCATKTPSTPTCQMYCSYYYTCIYGYQICNGVQDCPYGDDERNCATKTPSIPTCQMYCSYTSTCIYGYQICNGVQDCAYGDDERNCATKTPSIPTCQLYCSYYYTCIYAYQICNGVLDCPFGDDERNCVTATTTTATTTSPPTCQIYCMNFMYYYTCIYAYQMCDGVRQCYYGDDELNCDTRTTTAYCEKRCGSSVSCVLSSQWCDGVSDCPYGEDEMSCVRLYGADFQLQVYYTSVSAWLPVCSDYWNDDFGRFACQDFGYNGSSYNRYDTLMSPYAPNGYFKLYSGYWRSKFYTSVQYSSYCYSGNVVSLHCISCGVSYNSVVSRIVGGTFANLGNWPWQVNLQYITGVLCGGSIISPKWIVTAAHCVYGSYSSASGWRVFAGTLTKPSYYNASAYFVERIIVHPGYKSYTYDNDIALMKLRDEITFGYTTQPVCLPNSGMFWEAGTTTWISGWGSTYEGGSVSTYLQYAAIPLIDSNVCNQSYVYNGQITSSMICAGYLSGGVDTCQGDSGGPLVNKRNGTWWLVGDTSWGDGCARANKPGVYGNVTTFLEWIYSQMRTYR

SEQ ID NO: 676 - protein, 1003 aa, Homo sapiens
PRVRASRRDRLSRLKRELTQMKQELQYKEKGVETLQEIDRKMSSTHTSYKLDEAQAIMSELRTIKKAICTGEKERRDLMHSLAKLTDSFKNSCSVTDSLVDFPHHVGVPGDAGVPQQFCDAGSQTDIIGEFVFDDKTRLVDRVRLNWQYEEARKRVANIQQQLARLDNESWPSTAEADRDRLQLIKEKEALLQELQLIIAQRRSAGDVARLEEERERLEEELRRARATSAQGATERILLQEKRNCLLMQLEEATRLTSYLQSQLKSLCASTLTVSSGSSRGSLASSRGSLASSRGSLSSVSFTDIYGLPQYEKPDAEGSQLLRFDLIPFDSLGRDAPFSEPPGPSGFHKQRRSLDTPQSLASLSSRSSLSSLSPPSSPLDTPFLPASRDSPLAQLADSCEGPGLGALDRLRAHASAMGDEDLPGMAALQPHGVPGDGEGPHERGPPPASAPVGGTVTLREDSAKRLERRARRISACLSDYSLASDSGVFEPLTKRNEDAEEPAYGDTASNGDPQIHVGLLRDSGSECLLVHVLQLKNPAGLAVKEDCKVHIRVYLPPLDSGTPNTYCSKALEFQVPLVFNEVFRIPVHSSALTLKSLQLYVCSVTPQLQEELLGIAQINLADYDSLSEMQLRWHSVQVFTSSEPSRTREAGCAGESSARDPAHTISISGKTDAVTVLLARTTAQLQAVERELAEERAKLEYTEEEVLEMERKEEQAEAISERSWQADSVDSGCSNCTQTSPPYPEPCCMGIDSILGHPFAAQAGPYSPEKFQPSPLKVDKETNTEDLFLEEAASLVKERPSRRARGSPFVRSGTIVRSQTFSPGARSQYVCRLYRSDSDSSTLPRKSPFVRNTLERRTLRYKQSCRSSLAELMARTSLDLELDLQASRTRQRQLNEELCALRELRQRLEDAQLRGQTDLPPWVLRDERLRGLLREAERQTRQTKLDYRHEQAAEKMLKKASKEIYQLRGQSHKEPIQVQTFREKIAFFTRPRINIPPLPADDV

SEQ ID NO: 677 - protein, 1713 aa, Xenopus laevis
EPGAQSQLSTMWKWYSGDESTLQGGAPDNEGSPAGTMSVADLTEQLAQTEQLVVQLKELIREKDNELRKKDQQLKEKRESAESKISKAKLQNKAKIVSLTSQLEELKKQQASSRPHEKKSENKKASGDGDYENSSANRGKILLLKRRVEELESQLAHKNEELQKKEADLEQQRLRGSQMDAMLSEKEQKLAAKEAYIIDLQMAAGSNTSKNVPSSQDNTQETNKDKANQELQVLIQNLTRKVGESDEKCSLLQEQAESLKTLLNKEKDHFKAREAMYTENIRVFQNLVQEKEKELKEQSQKHEQDIFKLLAKSDANADLHQLLKALKQKLHEEEEVLLGKNQVIDVLQKELDNKEQQNMEITEKCKRLQSEKENLQSKLEAEKHVMRAQLRDMMDKHETELRGLHDKHVAQIQEIQEKHELEIQEKCLTVQQLQHQLQNLGNNVGETAQPTNITEMAVVKLQDEVKLKTEESQGKNQDLRGLSNRIVELEEEKHELETKLKTLTELQAINEQLLAKLVLYEEQQRKLQADLEQVAKRADSQTSESGSVDELHNQLLEWNEMSPEMEEAPENSSEEKSVLALRMAQIEEEREAMDSGQQELEEELSAARGLGKMRPARRKGSKAATKMQEEDDYSRKGFDDQNVTLDSIDSAEGENMGGLRTVVEELELERNQLQEQIMSLEDRCQELEDRLQLQLRIESLQGENERLQAQLGQLRQQQNRETEKQHSFTSTLSEQLKGFTDRNAFLENVIAEKEQIILEAAGKLEELARLKKILKEKEDLNKAIAEKLDQSELQLEETSKKLAVLETESQALKLSNNELTEKAATLKEKLLKQDAALEKMQLDLEQTNEELDRLNTSHLEERSQLIYDLQRCEREMDVLREVLQEKDKELASLSSSLTEYNEQVVILKEQIDLKNEQMREMSDALVKAERESQLLREAQTSDTREMSDKISSLTDQLSEMDMELNKAKYLSETKAKEAEELIRQINENGITIKNLRSEIQAQSATHNNHAIECSTQITSLKQQINASVAKLDETETKYRKEIESLKLQLESDVSEREKIAGLLAEKSSQERSFENELKVAKEQYNNLVSGISKKDEEIEKLLTEVAEQKKFCDHLRKELQIKEKDASSLQEKLLADIKDREEKLRGFQESTQALQAQLSEKLDNINKSDATKNELVEQNKILKTALSEKDKNLEVHLTATEECRKSILELEQHNQQLLNEKEHLAKELSEQKQFYDDLKKELNIKEENSLCLQQKLEMDINNRDEKLTVLEERVLELQKQLDEELENIHNLNTAKDELDKRNKILEVALAEREKNLSVHLNKTEECRKHILDLEQQKQQLYSEKEHLVEELAKQKQCCDHLTAELQATEQKASTLQQKHEAHLKDRDELLRVLQESTQKLQKQLEEKVEHINTLDAAKNGLCEQNKKLESSLAEKNENLGVYQNSAEELRRNIVDLEQQKQQLHSEKEHIRQELSARESALLSLNQVLHDLQGKMSEMELLLMEEKKWVSQLTLDKEELQLKISHMSEQSLERDTVISKQLEDKALESFSLKDQLSEEKQNAKNLLNQIHVQENQLKESQKRVQQSVEELELMKVEYNTIFESLKQNEERNVELQKHVEELTTALGRENQALKAELEQWKASFAALQNEENILREEHKRVSLQITELSAELLKLNVDQDRLQQEAVQKTEENASLLKSLDSINVVADTLKKKK

SEQ ID NO: 678 - protein, 765 aa, Xenopus laevis
MFSLKQPKPSFRSYLLPPQQEDKLNPETKIKKLKAVLLPGEIVVNEVNFVRKCIASDTSQYDLWGKLICTNFKISFITENSVPFQRFHYKNLLLGEHDVPLTCIEQIVVVNDTKRKQKILSHNQKLKFNPTELIIYCKDFRILRFRFDEAGPESAKKVCLALAHYSQPTDLQLLFAFEYVAQMYHKPEYKVNGIDPGGGGDFCQRTPLFETYSDWDREIKRTGASDWRVCSVNEGYMISTCLPEYFVVPSSLADQDLKQYSHAFVGRRMPLWCWNHSNGSALVRMASIKDLLQQRKIGQRVCSGITRSHPLRSDVYKCDLDHNVPSIQDIQAAFSKLRQLCVNEPFDETEEKWLSSLENAQWLEFVRTFLKQAAELAYVLDFSRRSVVLQEEEGRDVSCLVASLVQLMLDPYFRTIVGFQSLIQKEWVMSAYPFLDRCNHLKRSEKESPLFVLFLDCVWQLLQQYPAAFQFTETYLTVLHDSTRISLFGTFLFNSPHQRVQQSTEFAIARNIQLGEEKGLKFPSVWDWSLQFSAKDRALFNNPLYIGKSVPCVQNGAVKSFKRTKNYSSTMRGMPPSVKNGMAIQQDFMPRRNSLILKLKPEILQQVPVIIPSSGFEQYLRDWFTKPADLHGVILPCLHGTHIKLWKLCYLRWTPEAQINHGGFITAFHKISLLASEIELLQSRLRQYRAYPLSTVTSPVGEQNRMFFRPDELHSSNGSLDILTSSFPFSPIGNLCRRSILGTPLSKFINGAKIWLSTETLANED

SEQ ID NO: 679 - protein, 428 aa, Xenopus laevis
QPDMKHFPAGDLKGLQQVGKGGFGTVYKGWSQSLNMEVALKTIEGAQSFSINKLMKNILKEREVMEKASNPFVIRLLGMYERREGQAIEHGLVMEYMPNGSLRSLFDITDVPWALRFQMLHQVALGMNYLHTLDPPIIHRDLKPSNVLLNKHFDVQITDFGLSKIVGATTSATPSFAGTPSYMAPEALDDLNYKPTMAYDVYSFGILIWTVLSGEEPFPNAHPALIHFGVSKGQRPSLEVLGHLGHIKMVPEAKELMIKCWSGNPDERPSFLECSHSTRLMFEEYINEIEDAIRTVQDQKHHLQNEILEDPGYDSTFQDSLLNQVIAAIQEDSQEMKKDETQTVAVFNETTEIIQEDNEPSDKGDAISNAIEAIKESPDYNRIILCAKDIGKTVEKGGQEIGKVYKDYRGEITREKVSELWKPIRKLF

SEQ ID NO: 680 - protein, 2794 aa, Xenopus tropicalis
MGVTWTPVLLLSLCLSEMGVTWTPVLLLSLCLSGLGVADPVGKEFALVFMENSLPNVSMPHLEVFLSGFFSGTEVQVRLPNGSFEKVISLSPGSMVKVKLPAELEILQCSRSNMTIRISSNMDISVSAANEKPSSTGVFLVYPVTDWGTEYYMVTPDRGPANTFAQIAIVNGPLMNPIEVDLEGYVQFEGRIYSPGEQLRITLGPWESVMLQSNGSLTGTHLRAQEPVGVFSGHSCAQRSTRCNQVCLQLPPVASWGFHFVVPTLKFHGNSDTLYVTAASPTVLDIRNGSSLLTKNLLPGYIQELAVDSFVLMDISSSAPVMVLLYGYAPRSLHVFLVNVLSTEDICTAYYLFLMPGYNSTALVVVHNDSTTELQYNNEELPYIDWRSVNGTDVLWGPMFLGTNGPNIISHPDEAFAVYSFGRNGMNMYTAAGVCLEQVLQSCKDEGCEGALCPLVEQPTCYTDYQTCMAWGSTYYRTFGGRHTFQPAQDCATLLIAYPGVMGEDWPFSVERSPEEEFSLTFRTYGDTVEVTEDMSGRIKACHKQICPKPFIDSCLHALCTESGNRTCSALEAYALACAMEGVNLTTWRTIAKCDLQCPPQSHYETCPSAPPRACLVSEGYFYSPCDGNNCIETCVCEEGLQLSMGACVPSNQCGCSWKGGYYPNGAEFLSSGCSMKCRCQGSEVECQPTQGCGVGQRCDLGSGSWSCNPYTYLSCSVLGDLNYTAFDGQQYKFQGSCLAKMAGLCSSLPGLEYFELYLEKEGKSNFTTAVILKIYRTTVTISQDNDHVEVNGDSVRLPFVLHDRRLQVFRSGLNAIVLQIDFGLVVSFDSSNGFLLVRVPDSYTNAVCGACAAPSDIVPGVQACGASCTGDCIECGAAEKESYRSFNNCGIITDLQGPFRDCRTRVNTESYFQNCLGNMCRHNGSQVALCQSLGGFVAACQEAGGTVYSWRTEELCKPSCPANAQYELCVSSCPDTCNGSLPLPCPLPCKEGCPCNPGYTQSGDMCALPEDCGCLFHGQYLKPGEATLTDGCSQECVCQNGATACKDYACDPGQMCLVHQGVRGCSAPKSPICWVSNNLHYRSFDGTTFNGNVNCSYVMAKVCKMDNLTTEFELHVTGDLDENSGMYQLKEVLLNVYGYTLSLSTETQGILVNGTAQYNPIDLENGKISAISHISSILVSTDFGLSVSLSYSLLSIQIPSNYSGKMCGLCGNANQNANDDQNINATLSKWLSRPGQGMCDSPVQDFSNDFPNETAQFSNSSQYCAVLVDPEGPFMSCLVSVSPVSFYEDCLMNFNMGGGFNKYICSTIEGYARTCQLAGSTVYPWRNESFCPAGCPANSNYTICKDPCSPTCIDPFRYTPCQSMCSEGCECNSGFYEDGGRCVPTEACGCYVQGYYYPQGYVGIDEDCQQNCSCPQFNQWQCEPLSCPSESICEVQEGVRNCYPREMLNPADHTECIFSPEAPACTNIITCGFYGSSRYETFGRTQWNQPSGVNALSVAYSCDSDLVYNVTATSESLGSVEEVIINVYGITIVIDRIQEIWVNETKIDVPTELVPGKVWLKAHSHAVLLKTDFGLTVLFKGGEYLFIMLPAGYLNSTCGLCAGVNMTMGLAATPSAMVAAVTTPGAVATAAATPMTPVAAATLVTPVAAATSSAIVAVATPSEGNQSFSDTLSSWNCSDSDHPGASLCMILLDNDGPFGACHEVLDPYLYYDACLSSQCQKGGNIAGVCQSLQNYTLSCQQQNQTIEPWRNDSFCPFACPMNKHYSICVDPCGETCTAPNGTSSCNLTCIEGCECNVGLYREGDKCIPIEACGCNANGTYFKKGTEVFGDNCHRKCSCPRFDQWQCESFTCQPNQICDMWAGIERCFQKDLLAVLKALECLLFPKEPGCANYTNCAFIGKLGYLSFWKKVIFGGLSTSDSLSVAQSCVEANAGNSTNPFYDISVKFANGSEQQIESVLINVYDMDIVIEKSEHSKKFKVWANGIQVNSSSALIPGKIRLELDIVAVILGTDFGLSVVVNSPGYLYIFLPTSYLNSTCGLCAATVAQNTFSNTSVGNQTLNDIPVTWNCNNTDPTGSSLCRMLLDEDGPFGACHDVLSPSTYFNVCVDYQCDNKEDISAVCQSLQDYTDSCQAQNQTIEPWRNDSFCRPTTSEENLQCVFYPNRSACAQDIHCAFSGRNGYLTFGRKFGFQHLPWPHVLPLAHSCDTDNIDNSIDSTYNVSVKVLDGSEKVMETVIINVYETDIVMEQKEQLRVWANGTPVVIPSVLIPDRVWLKQSDHFVILTTDFGLTVQNDGRYFLYIDLPQSYLNSTCGVCASTESPTDTTNGSWGGNQALNNATNTMPTNAVLGGGTQAVTSTPSSWHCNETDSMGAILCEMLLEINGPFAACHEVLSPSPYYDLCLSHLCQNGVYLPAVCQSLQSYTSACQAQNRSIEPWRNDSFCPFVCPGNSHYEICVDPCEATCSHPNRTSCDSLCMEGCECDQGFYAEYNLCLLIEDCGCYVNGSYYPQGYEIITEGCQWKCSCPQYNEWTCDPFSCRSNETCKWTNGARNCYPQGFSCPPGNEYSDCTTVCDRTCKNNSCLRPCMEGCQCPNGSYWDGNSCVTAEQCLGSGNQVQSSPQAIGVPCEISSQNSSQPLCLQCIVSSQNIITWNSTSRSLEADVPYEILRVCEDSDKLWLRVVLQTLTTGQMLHVFFGQSFITVRSDLEVLVNGDTVLTPLTEFPDLQVDQSDNAVTISLPGDMVATFSWDGLLTIMVSMDFSTTLCGACAYGNMAPGNTTNNLLDCCKAEDFADL

SEQ ID NO: 681 - protein, 2861 aa, Xenopus tropicalis
MGVSLRSFFLLSLGYGLCMAGVPGTEFVTVFIPNTNYQTGYPDLQLIITALSPSTTVTVRVNKYNFKKILTLDKGEENTVALPNKIQTQPGVSFPYSVIVISDNPVSVVSRNMKKGTSDSASLYPVEELGTEYYVFTPPRGPAGSYKEFAVVTKEPTTVTISLTGSVTFQNRQYRKGSKLTVNLEPYEAVSLQSEDDLTGTKVVSVKPVAVLSGHSCATLKTRCSHVYEQLQPVPVWGSTYLIAPLAYQTSFDLVYITAAQDTLVTYQIDDEKNTFKMSEGDTTEIELKSNAPISISSTEGIQVFLFSAGGRQDTRVFDTFLLGVPDVTSFCTSYQAVGKDTPNNVAYIVAKTSSLQGVTVDKQPLGKANWQNIVGTGYSWGSFLLNSDDRNYMVENTGSTFGLIVVGVSTTNVYGELATCVGVTLKGGNLTLQQSGSLLVLVTDFGLRVFYDWNMLFKIYLPSSFSENVCGLCGNFNNIPGDDLYSQDHVSLDPIAYGQLWKVQGSSSSTCWDDCNGPCKTCSPSDKQKYADPSSCGIIALKENGPFRLCHAAVDPRIYLDNCIYDLCLNDGFQQILCQTLKTYSDACRRENVQVFEWRNATGCNMECLPNSAYKFCGSACSPTCEDPDAPSKCTEPCIETCECNAGFVMIEGKCMPKENCGCLYQGRFLAPNQTFWADTGCKQRCTCDANTRTVTCKKTGCRSGEECVVKNGIQDCYAISYGQCSASGDPHYITYDGLHYNFQGTCQYKLSGLCKQNKGLTDFQVNVRNQNRGSRAVSYVTAVNLTIYSMEIQIRRDYPDQVLVDGLLSNLPLTLSSGRISVFRSGRHCIIQSQLGLRVAFDWDARVAVTIPSSYAGSVCGLCGNFNNQPDDDLMTLDGSITTDSIEFGNSWKVADLPGCSGGAPENCNLTALEKVQRKSKTECGMILDKKGPFRECHSIIPPEDYFQDCIFDMCAYGKRPDISCRLINGYTSACQEAGANIYPWRSEEFCKLPCDDNSHYNVCTSACPSTCLSLASHTTCDIKCQEGCACDDGYVLSGGHCVPLSDCGCTYNGKYYKPEEVFFPEDNCDKKCSCAYGGIVTCSSFSCDPYEECRVEKGVQSCQPVGSSTCSVVGDGSYWTFDNQKYEFYGNCSYILSKSCLPDGSKLTPYVIHLQNQEVVTGGVTKRKVLTLEAYGYNVTIYIESEITMLVNGILQNLPFDLESGKLRGDHQGLGVVLRADFGLVITSDFSLHVTVPGNYHNYTCGLCGDYNEIPEDDISPADDVVTFADSWKDSNSDMFCGSSELCGGENQTCPICPSNKAKILKGNNYCGILVKSDGPFAACHGTIDPKMYRASCVNSLCDGTGDLCLILQNYVAICQASGVQMNSWRTPSFCPLTCPENSHFESCVDLCTTSCSSLYDTSICPTSCSEGCECDEGYLFQGGQCVPPKQCGCYMSNSYYKANQTVVSQDCSQTCTCYSNRGMICEPYSCGPKEVCTIIEGIVGCINVDPCKSVTCRNKESCKVQDGTPVCVPDYTGVCWAWGAPHYQTYDNFNYQFEGTCTYVLTEYIGQDTTLVPFRIEEQKENRGSPIISFIRQIDVFVYGYKISVAKGEYGKVRVNDEIGNTPVTLLNGKISVTFSGSEAILNTDFGLQVTYDYNTKVMVSIPSSYYASTGGLCGNFNQDPDDEKVSSDNKPVESVTEWAKSWKVNVNDSFCWDACEGNCTACDDNMISQYSQDNACGLLNKTINGPFRECLSIINPERFFSNCLYDLCNSGQALNIHCTTLQSYAEMCRSQGVTIYDWRTSSECPFPCPENSHYEVCGTSCPASCFDRNAPNRCTEACVETCQCDDGFILSAGKCVPIESCGCSQNGFYYQPNQEFWNDDKCSVHCKCNPLLGLVECKDSSCKAGERCALVDGVQGCYPEDYTTCVSSGDPHYTTFDGRKYNFMGTCIYQLAGVCSTDPTLTPFQVNVQNEARGKKTVSYTKAVTLQVYGQNITLTRNYPLQILVNGVLKSLPFSFRSNKIKAFMRGEHCFVRTDFDVTVNFNWDNYARVVLPSRYIGAVCGLCGNNNKDPKDDVPVADGDQVPDSFGDAWKVGDVAGCTSGCNGKCPECSETDTLKYKDEKYCGILSKDDGPFKECYGVIDPTPYLTDCVYDSCQYKGYYSAVCDAFALYASRCQEKGVNIEPWRTPTFCSPTCPPNSHYEMCGSGCQPTCSGLITSDDCQKSCTEGCYCDSGFLQSGGQCVPFAECGCLYREAYYKKGEEFYPDGDCKQFCQCLENGEVQCQEKTCGANEECMVINGVQACHSTNIGTCGVSASTHYSSFDGLSYNFQGSCSYTLTEVCRGDLRLANFSIVVENGNDKQSNQAVLRSVSINVYGHEIVLTKDTLWTIQVNGETNALPLTLENKKIRITPEGSNILLQTDFALTVLYSTLGSVQVTVPGDYQEALCGLCGDFNGQSNDDFRLPSGQLADSLEDFGEAWVTNQERSDCGNVCKANCDGCDPLRAAIFARDEACGQILLETGPFAECKALVNVTEYFDHCLFDMCASDGQNQALCASLQAFVAACQAAGANVQPWRTSTLCSPSCPRNSHYDVCAQTCDGSCAAIDLSGSCSERCFEGCECDDGYMFDGKNCVPMEKCGCVYNGRYLSAGDSLLSPDCLQSCTCGNGGVVSCTNASCSDAQYCDLQNGVRACYDKRGTCSIDIEGGLITFDKLSGQVPRSNIFDFASVCNLDLNAWFRLVVITQSCSGNDGFIISAVHAYFQSVSIAINPYGQTWVNGRNVAIPAQLSGSLSVFAVDDSIVLKKGEDMVLVMGTNGQLTLNVSPELSGAMCGACGNFNRKISDDLQGPDTKLTDNFRELITSWRSSDFYMCAP

SEQ ID NO: 682 - protein, 2011 aa, Xenopus laevis
MAAQLALNSEASLWGPYREIWQTVLSALIKRQPEAVHSLDIVLKKYKPDFISLFKNPPKSAQQHERVQKASTEGIPIKGTQRTRILEEQLIKEAFILSDLYNIGEIAAVELLLIGEQQQPTFHGLTRGLVAILLYWDGKSCMAESLLHLIQARKGKTFTLDHSPEVVSMVTRFTDDLMEQGLTNKILTLISQIDVNNEFDKLKKERGLGNKKHRKEVSDLIKECQQSLAHSLYSWSCQTPLNREDTLLLIGYLEKVTVEGDGSLDKVNLTLLMSLLYCLDVGFLEQGTDDREELMKQASMFMDRQYIAAIHNRLQNTQPWKSPGMQATVRLAWALALRGISQFSEVLEFSEADEPMAEIAIGGNVFLFLTEAVVGSESFCTDEFFIRRIHKLVTDFPTLMPMKVKQLRNRAEEDARLIQMSMQMGNEPPASLRRDLEHLLLLIGELYRKDPFHLELALEYWCPTEPLQSTSLMGSFLGVAHQRPPQRQVLLSKFVRQMSDLLPATLYLPYLKMLRGLASGPQCAHYCFSLLKANGGSSAENLQAAGGSPVSWDHFFHSLMLYHEHLRRDLPNTDNIHQRHPPLRGITQRELDGLIACLQLTCTIIDWSESARLALCEHAQWMPVVVILGLLQCSIPPLLKAELLKTLAAFGKSPEIAASLWQSLEYTQILQTVRATGLRQGVGIEVELNEIESRCEEYPLTRAFCQLISTLVESSFPTNLGAGLRAPGFEPYLQFLRDTVFLRYRTRAYRRAAEKWEVAEAVLDVFYKLLKDYEPQPEDFVDQYVELQGEERVAFKPPGFSLMHHLLNESPMLELCLSLMEEGVTQLDTYAPFPGKKHLEKAVAYCFMLLNLTLQKENRFMDLLRESHLSMIVTPLEQLLQGINPRSKKADNVVNIARYLCHGNSNAELAFESAKILCSISCNSKIQEKIVGDFTQDQNVSQKLMVGFVSCLDSEEAEELLDSEKEAEDQVKQTNIRYMTKIHILNLLITSLEMKAPNLAMFLLGYELKKPVSTTNLQDSGVLGCPRTCLHSILDILRKGTDVRAGPVAVWDTPHLAELCYQVIYQLCACADTSGPTMRYLRTSQDFLFSQLQHLPFSVEESEISAMNQMSWLMKTATIELRITSLNRQRSHTQRLLHLLLDDMPTRPYSADGEGGMEDESRSLSGFLHFDTTSKVRRKILRILDSIQFSNEIPEPLQLDFFDRSQIEQVIANCEHKNRRGQTVCNVKLLHRVLVAEVNALQGMAAIGQRPLLMEEINTILQYVVERNKLLQCLHAKRHALESWRQLVEIILTACPQDLIPTEHRQLIIRDLLQDLHVKILDDDAAQELMPIVAGAVFTLTAHLSQSVRTELKQPMTASGLGQSQYVQMLDGSFAAPPGTENISAGFASIGDSSLHMILRNLLEFILKTGGGFQRVRAHLYGSLLYYLQIAQRPDEPDTLESAHKSMWERLTAPEDVFSKLQRDNLSIFESYGTALMEVVCRDACDGHDIGRMLALALLDRIVSVDRQQQWLLYLSNSGYLKVLVDSLAEDDVVLRNLLTPQPPLLKALYIYESKMAFLTRVAKSSQGAIELLRSGVIVRLAQCQVYDMRPETDPHGVFGMRETPVFIPAPVERYRQILLPALQICQLILTSSTAQHLQAAGQVLQFLVAHSDTIQAILRSQEGSLGSLQELALLTGIISKAALPGVLNELDIGLNDGSMMELQGHIGRFQRQCLALLNRFGGSDRLRQLSLQDDSSRLDGVSKKDDMELAMQQICSNVMEYCQALMIQNSPSFQQTVCLFTPSLKESASRDGTRQDSQVSILPSWRLPSLGVVIHLLKQSANNFFTYYDIHRQSVGKLQNVEQLPPDEIKELCQSEMPVGADKISTTQKYGLARRRLVKLINSRAKLLSLCSYIIETCLYILWRHLEYYLLHCTTSDSQDPVFSNMTFGNRRFQDTFNTDPNMDPRNLRQNKVSQQDVDTLLREGANSFGESLQKRLLDIESLYCKVRSRHSFIQALVRRIRGLLRVSRV

SEQ ID NO: 683 - protein, 485 aa, Xenopus tropicalis
MDNRCCEGKGDFISGSGKEEKDTRNPELSELKRKRDVDEEKTERDSESKRFKILHIIDNICQKQHQQKKTEVQKKEENTKKRERPSDDGEPAEEERELKKPCLEAERPNPLLIDNYKLHKVLGIGSFGKVLLASLVNTTEHVALKFIRKKDNVQHQESIRAEARTLQIARECPFLCKGLAAFQTPLHAFLVMECVSKTSLYHLLREKQKLDMETVIFYAAELVVGIQFLHSRGIVHRDLKLNNILVNTEGHIKIVDFGMVAEDILGEKKITSPAGVCHFMAPEQHLKKPYGPGVDWWAFGIILCTMATGKSPFYSGTKLDCLVHSVTRTKPCYPEGLSTEAMKLLDEVLEKDPERRLGTRGDIRSHPFFNSIDWADLESLKAPSPWKPEGLSEKDFGDYKEPLLCLEDQKRMFSSRKPVILQEFSYVSSSCPQPTAYTTGSLSSAHTIEPFPQAHAIGNLPTAHAIGPLPTAHTIGPCLRPTLSA

SEQ ID NO: 684 - protein, 905 aa, Xenopus laevis
MKVLEDYRSLVHGIGSLDFSGDAVPCKLLLTGDTAFPVLVTPRKDVLIAASRYGKGKVVVMAHESYLNTNAFMDFLKNAVSWLSPNSEANIGVHKGLNLLTDNLSANGSKVQNTSTLIEGLGVFCTIGYDDSQDKQIISFVREGGGLLIGAQAWHWSYSHKQENVLHHFPGNKIISVSGVHFTSDYGEKGNICVMENIPQAPIYTSFDFSLDQKYLLKGMSQLDISGSSIPSDLLLHGTLSFPVGLSENKQCFLGATYYGKGRVVVATHEGYLSKSELKTIMLNAISWLDINQNRRIGVHKGLRQFAELLQKENIPCNISSLDPDLSVYCCTSYSDAEAKAIHEFVAEGGGLLIAGHAWYWSSQNSDLDVLIQYPGNKILNKFGISILDRTIPGGNYNAINPDESSQQYHFRRGLCNLQAELRSGAEVKPPLSIWMNKLRQDVTAFMRLPANPIISSIQSQFVEMMQICEIPNVTKQCPVSSCSKEAFILCLAQECFNVCDESHILEKEPSITVEIDGTNPGNNAWRSTGLYLAPRKTAVLEFPASAVHQGLQVQVGCQSDDLSSADKYCRAPVVVRRFHVDSQRVSVSCFWGGLVYITVKANSNLGIIPVKVYEAEPAPIYIKGKTSLDTWIQSIRNLPAPWAELITENIILTVPSDAIRSLSDPEALLSLWDKIMVAITELAAIPKKLPRPERFVADVQISAGWMHAGYPIMCHLESAKELTDLNIMQTGGIWGPIHELGHNQQKTNWELPPHTTEATCNLWSVYVHETVLGIPRSQAHCCLQAETRANHIQEYLRNGSNIEQWNVWTALETYLQLQEGFGWEPFKQLFKDYQSMSGIRNENKSKMNLWAEKFSEAVQTNLVPFFEAWGWPIEEATHSKLSVLPVWEKDPMKSYLSARKSNSN

What is claimed:

1. A method for identifying an agent that modulates a cell division and/or differentiation signaling pathway comprising:
    (a) contacting a solid surface linked to an Aurora A protein with a cell lysate or cell extract sample in the presence or absence of said agent;
    (b) determining the effect on spindle formation, microtubule nucleation, or lamin-membrane matrix assembly wherein a change in spindle formation, microtubule nucleation or lamin-membrane matrix assembly compared to a control in the absence of the agent indicates an agent capable of modulating a cell division and/or differentiation signaling pathway.

2. The method of claim 1, wherein the method further comprises the step of adding Ran protein to the sample.

3. The method of claim 1, wherein the cell lysate or cell extract sample comprises one or more proteins selected from the group consisting of Spindle Assembly Factors, filament proteins and kinesins.

4. The method of claim 3, wherein the cells are HeLa cells, NIH3T3 cells or embryonic stem cells.

5. The method of claim 3, wherein the cell extract is *Xenopus* egg extracts.

6. The method of claim 1, wherein said solid surface comprises beads or dots.

7. The method of claim 1, wherein said Aurora A protein is wild-type Aurora A.

8. The method of claim 1, wherein the method further comprises a second control, wherein the Aurora A protein is not present in the sample.

9. The method of claim 1, wherein the method further comprises a second control, wherein a known inhibitor of microtubule nucleation, spindle formation or lamin formation is present in the sample.

10. The method of claim 1, wherein said solid surface is magnetic beads.

11. The method of claim 1, wherein said solid surface is quantum dots.

* * * * *